US 11,111,481 B2

(12) United States Patent
Tuller et al.

(10) Patent No.: US 11,111,481 B2
(45) Date of Patent: Sep. 7, 2021

(54) ATTENUATED VIRUS MUTATED AT SITES OF EVOLUTIONARILY CONSERVED RNA STRUCTURE

(71) Applicants: RAMOT AT TEL-AVIV UNIVERSITY LTD., Tel-Aviv (IL); YEDA RESEARCH AND DEVELOPMENT CO. LTD., Rehovot (IL); SYNVACCINE LTD., Tel-Aviv (IL)

(72) Inventors: Tamir Tuller, Herzeliya Pituach (IL); Eli Goz, Herzlia (IL); Shimshi Atar, Kiryat-Ono (IL); Hadas Zur, Tel-Aviv (IL)

(73) Assignees: RAMOT AT TEL-AVIV UNIVERSITY LTD., Tel Aviv (IL); YEDA RESEARCH AND DEVELOPMENT CO. LTD., Rehovot (IL); SYNVACCINE LTD., Tel Aviv (IL)

( * ) Notice: Subject to any disclaimer, the term of this patent is extended or adjusted under 35 U.S.C. 154(b) by 183 days.

(21) Appl. No.: 15/764,691

(22) PCT Filed: Sep. 29, 2016

(86) PCT No.: PCT/IL2016/051069
§ 371 (c)(1),
(2) Date: Mar. 29, 2018

(87) PCT Pub. No.: WO2017/056094
PCT Pub. Date: Apr. 6, 2017

(65) Prior Publication Data
US 2018/0273911 A1 Sep. 27, 2018

Related U.S. Application Data

(60) Provisional application No. 62/234,822, filed on Sep. 30, 2015.

(51) Int. Cl.
| | | |
|---|---|---|
| *C12N 7/00* | (2006.01) | |
| *C12N 7/04* | (2006.01) | |
| *A61K 35/76* | (2015.01) | |
| *A61K 35/12* | (2015.01) | |
| *G16B 99/00* | (2019.01) | |
| *A61K 39/12* | (2006.01) | |
| *A61K 39/00* | (2006.01) | |

(52) U.S. Cl.
CPC .............. *C12N 7/00* (2013.01); *A61K 39/12* (2013.01); *C12N 7/04* (2013.01); *G16B 99/00* (2019.02); *A61K 35/76* (2013.01); *A61K 2039/5254* (2013.01); *C12N 2770/24121* (2013.01); *C12N 2770/24162* (2013.01); *Y02A 50/30* (2018.01)

(58) Field of Classification Search
None
See application file for complete search history.

(56) References Cited

FOREIGN PATENT DOCUMENTS

| WO | 2008121992 A2 | 10/2008 |
|---|---|---|
| WO | WO2008121992 | * 10/2008 |

OTHER PUBLICATIONS

Clyde et al., Journal of Virology, 2006, 80(5):2170-2182. (Year: 2006).*
Coleman JR, et al. Virus attenuation by genome-scale changes in codon pair bias. Science. Jun. 27, 2008;320(5884):1784-7.
Sievers F et al. Fast, scalable generation of high-quality protein multiple sequence alignments using Clustal Omega. Mol Syst Biol. Oct. 11, 2011;7:539.
Altschul et al. Significance of nucleotide sequence alignments: a method for random sequence permutation that preserves dinucleotide and codon usage. Mol Biol Evol. Nov. 1985;2(6):526-38.
Zhang Y et al. SPARCS: a web server to analyze (un)structured regions in coding RNA sequences. Nucleic Acids Res. Jul. 2013;41(Web Server issue):W480-5. doi: 10.1093/nar/gkt461. Epub Jun. 8, 2013.
Lorenz R, et al. ViennaRNA Package 2.0. Algorithms Mol Biol. Nov. 24, 2011;6:26.
Mathews DH, Revolutions in RNA secondary structure prediction. J Mol Biol. Jun. 9, 2006;359(3):526-32.
Mathews et al. Expanded sequence dependence of thermodynamic parameters improves prediction of RNA secondary structure. J Mol Biol. May 21, 1999;288(5):911-40.
Wuchty et al. Complete suboptimal folding of RNA and the stability of secondary structures. Biopolymers. Feb. 1999;49(2):145-65.
Zanini et al. Quantifying selection against synonymous mutations in HIV-1 env evolution. Journal of Virology 87(21) • Aug. 2013.
Jackson. Alternative mechanisms of initiating translation of mammalian mRNAs. Biochem Soc Trans. Dec. 2005;33(Pt 6):1231-41.
Selby et al. RNA polymerase II stalled at a thymine dimer: footprint and effect on excision repair. Nucleic Acids Res. Feb. 15, 1997; 25(4):787-93.
Tuller et al. Multiple roles of the coding sequence 5' end in gene expression regulation. Nucleic Acids Res. Jan. 2015;43(1):13-28.
Alcaraz-Estrada et al. Insights into dengue virus genome replication. Sep. 24, 2010, Future Virology, vol. 5, No. 5, 575-592.
Zuker et al. Optimal computer folding of large RNA sequences using thermodynamics and auxiliary information. Nucleic Acids Res. Jan. 10, 1981;9(1):133-48.
(Continued)

*Primary Examiner* — Nicole Kinsey White
(74) *Attorney, Agent, or Firm* — The Roy Gross Law Firm, LLC; Roy Gross

(57) ABSTRACT

Attenuated viruses and methods of designing them are disclosed. In one embodiment, there is disclosed an attenuated form of a virulent virus comprising an RNA encoding a viral protein or a nucleic acid sequence transcribable to said RNA, wherein the folding energy or structure of the RNA is changed at positions of evolutionarily conserved RNA structures with respect to that of said RNA encoding said viral protein in the virulent virus so as to bring about attenuation of the virus.

**18 Claims, 10 Drawing Sheets
(9 of 10 Drawing Sheet(s) Filed in Color)
Specification includes a Sequence Listing.**

(56) References Cited

OTHER PUBLICATIONS

Nussinov, Strong doublet preferences in nucleotide sequences and DNA geometry. J Mol Evol. 1984;20(2):111-9.

Workman et al. No evidence that mRNAs have lower folding free energies than random sequences with the same dinucleotide distribution. Nucleic Acids Res. Dec. 15, 1999; 27(24): 4816-4822.

Rivas et al. Secondary structure alone is generally not statistically significant for the detection of noncoding RNAs. Bioinformatics. Jul. 2000;16(7):583-605.

Clyde et al. "RNA secondary structure in the coding region of dengue virus type 2 directs translation start codon selection and is required for viral replication." J Virol. Mar. 2006; 80(5): 2170-82.

Goz, et al. "Widespread signatures of local mRNA folding structure selection in four Dengue virus serotypes." BMC Genomics. 2015; 16(Suppl 10): S4.

Kobayashi et al. "Computational and molecular analysis of conserved influenza A virus RNA secondary structures involved in infectious virion production." RNA Biol. Sep. 2016;13(9):883-94.

Shen, et al., "Synthetic Biology Approaches for Vaccine Development". Synthetic Biology. Advances in Molecular Biology and Medicine. vol. 1, 2015, pp. 589-609.

\* cited by examiner

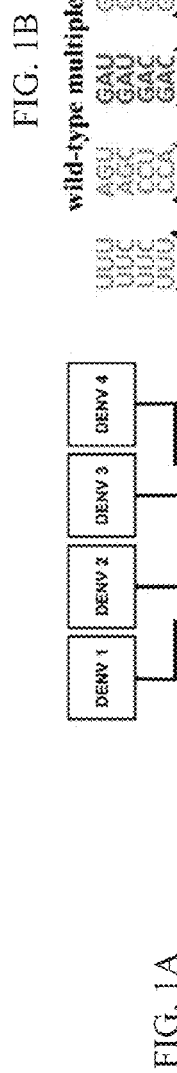
FIG. 1A
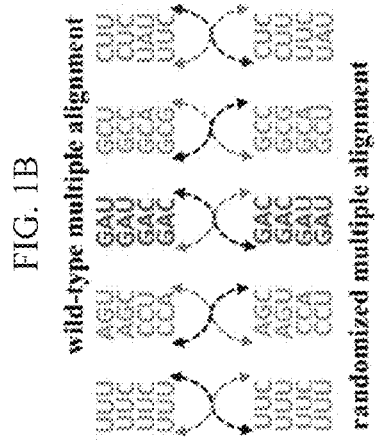
FIG. 1B
FIG. 1C
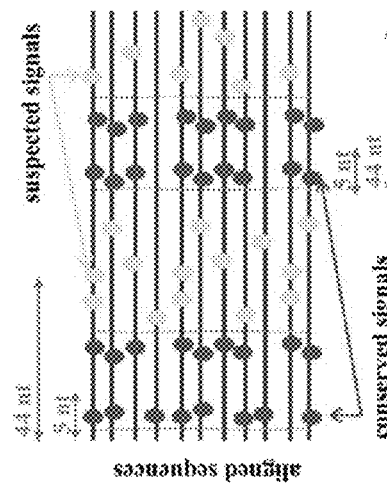
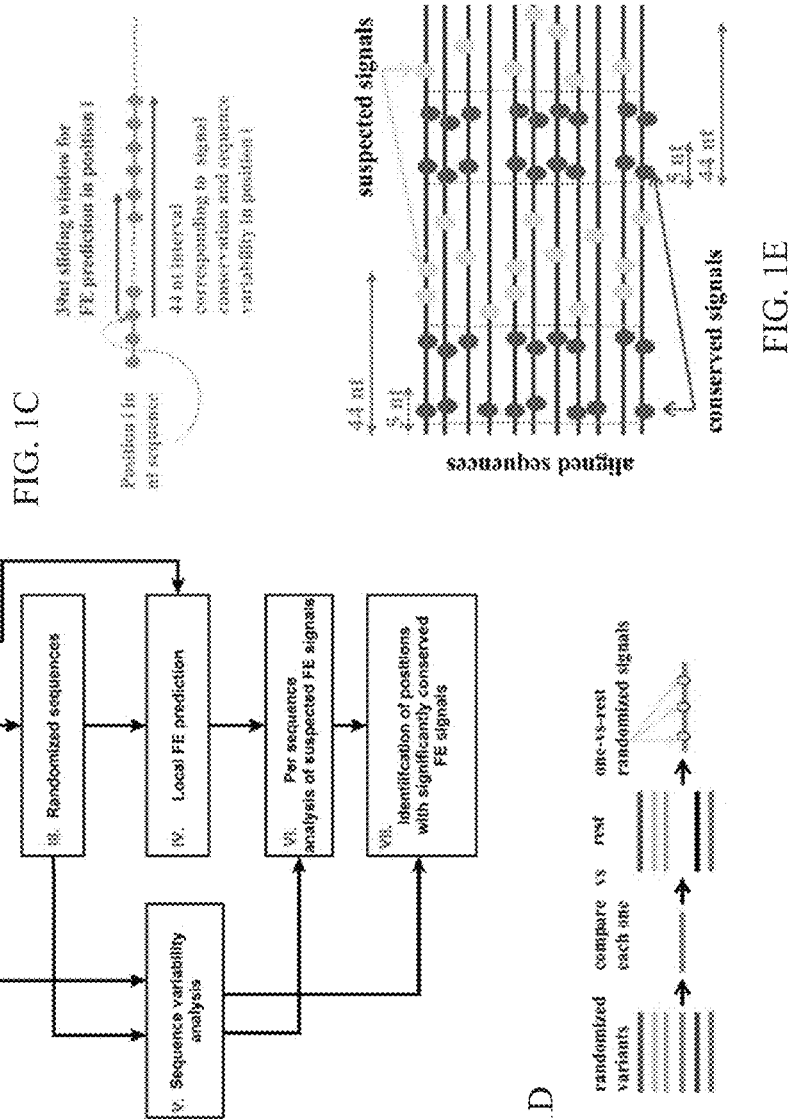
FIG. 1D
FIG. 1E

I. Identification of salient regions (SR)

SR selected with respect to weak folding

SR selected with respect to strong folding

- Wildtype genome
- Strong folding SR
- Weak folding SR

II. Construction of live attenuated genomes

Strong folding SR mutated to have the weakest possible folding subjected to wild-type protein and CUB constraints Weak folding SR mutated to have the strongest possible folding subjected to wild-type protein and CUB constraints

- Mutated strong folding SR
- Mutated weak folding SR

III. Replication in host cells / model organisms

IV. Replication analysis

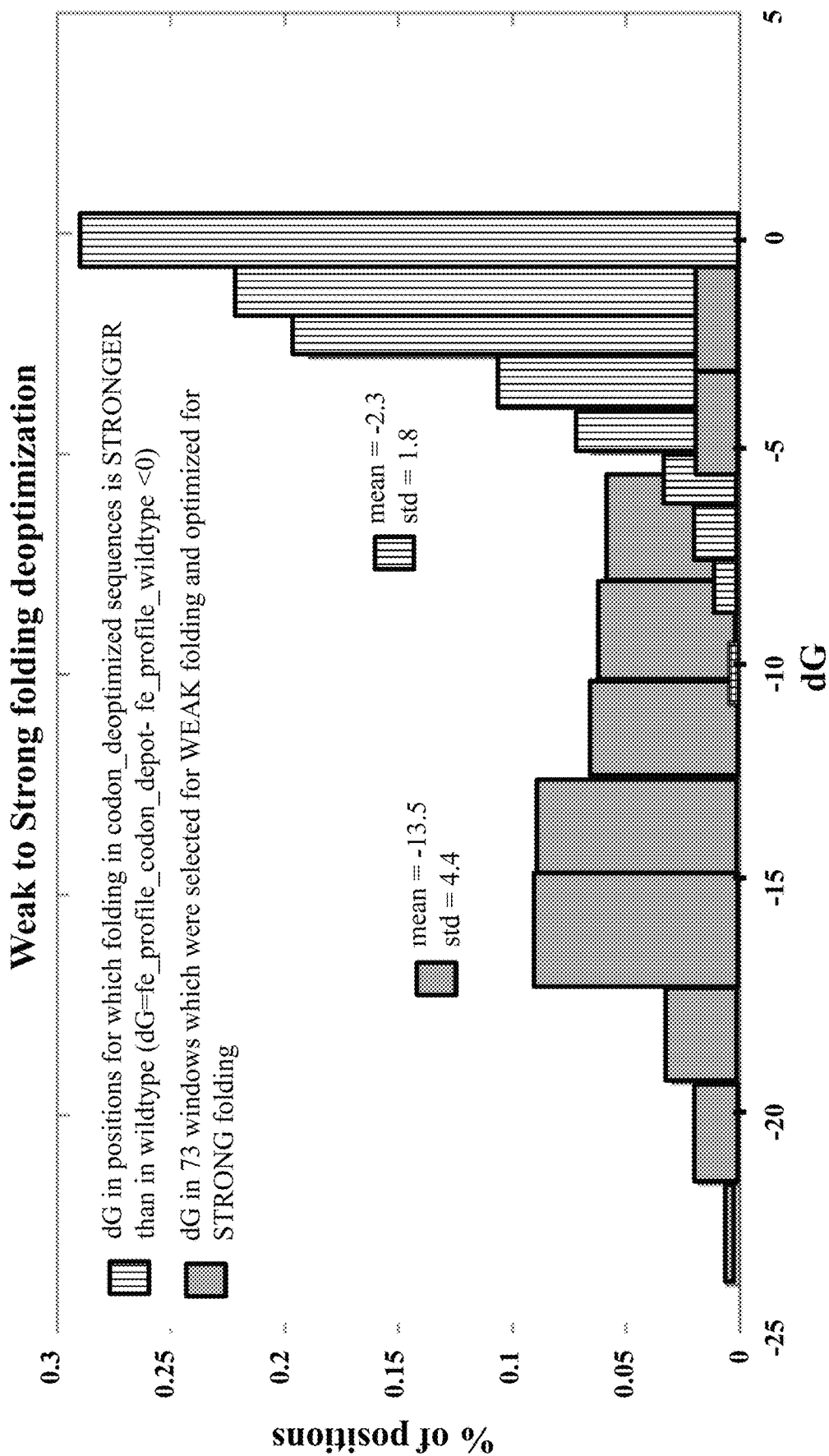

ATTENUATED VIRUS MUTATED AT SITES OF EVOLUTIONARILY CONSERVED RNA STRUCTURE

RELATED APPLICATIONS

This application is a National Phase of PCT Patent Application No. PCT/IL2016/051069 having International filing date of Sep. 29, 2016, which claims the benefit of priority from U.S. Patent Application No. 62/234,822 filed on Sep. 30, 2015 entitled ATTENUATED VIRUS MUTATED AT SITES OF EVOLUTIONARILY CONSERVED RNA STRUCTURE. The contents of the above applications are all incorporated by reference as if fully set forth herein in their entirety.

FIELD AND BACKGROUND OF THE INVENTION

The present invention, in some embodiments thereof, relates to an attenuated virus comprising a modified viral genome containing a plurality of nucleotide substitutions.

Viruses have always been one of the main causes of death and disease in man. Unlike bacterial diseases, viral diseases are not susceptible to antibiotics and are thus difficult to treat. Accordingly, vaccination has been humankind's main and most robust defense against viruses. Today, some of the oldest and most serious viral diseases such as smallpox and poliomyelitis (polio) have been eradicated (or nearly so) by world-wide programs of immunization. However, many other old viruses such as rhinovirus and influenza virus are poorly controlled, and still create substantial problems, though these problems vary from year to year and country to country. In addition, relatively newer viruses, such as Human Immunodeficiency Virus (HIV) and Severe Acute Respiratory Syndrome (SARS) virus, regularly appear in human populations and often cause deadly pandemics. There is also a potential for lethal man-made or man-altered viruses for intentional introduction as a means of warfare or terrorism.

Effective manufacture of vaccines remains an unpredictable undertaking. There are three major kinds of vaccines: subunit vaccines, inactivated (killed) vaccines, and attenuated live vaccines. For a subunit vaccine, one or several proteins from the virus (e.g., a capsid protein made using recombinant DNA technology) are used as the vaccine. Subunit vaccines produced in *Escherichia coli* or yeast are very safe and pose no threat of viral disease. Their efficacy, however, can be low because not all of the immunogenic viral proteins are present, and those that are present may not exist in their native conformations.

Inactivated (killed) vaccines are made by growing more-or-less wild type (wt) virus and then inactivating it, for instance, with formaldehyde (as in the Salk polio vaccine). A great deal of experimentation is required to find an inactivation treatment that kills the entire virus and yet does not damage the immunogenicity of the particle. In addition, residual safety issues remain in that the facility for growing the virus may allow a virulent virus to escape or the inactivation may fail.

An attenuated live vaccine comprises a virus that has been subjected to mutations rendering it to a less virulent and usable for immunization. Live, attenuated viruses have many advantages as vaccines: they are often easy, fast, and cheap to manufacture; they are often easy to administer (the Sabin polio vaccine, for instance, was administered orally on sugar cubes); and sometimes the residual growth of the attenuated virus allows "herd" immunization (immunization of people in close contact with the primary patient). These advantages are particularly important in an emergency, when a vaccine is rapidly needed. The major drawback of an attenuated vaccine is that it has some significant frequency/probability of reversion to wt virulence. For example, for this reason, the Sabin vaccine is no longer used in the United States.

To overcome the numerous pitfalls attributed to the classical vaccine design strategies, more efficient and robust rational approaches based on computer-based methods are highly desirable. One direction in designing in-silico vaccine candidates may be based on exploiting the synonymous information encoded in the genomes for attenuating the viral replication cycle while retaining the wild type proteins.

Some existing computational strategies may propose methods for designing life attenuated viral strains by using the additional layer of information carried by the distribution of codons encoding the viral proteome [1].

However, these have been tested only on a limited variety of viruses, were based on specific global features encoded in the genomes (while ignoring other important, possibly local, factors), and did not take into consideration the evolutionary dynamics as a general determinant of a possible significance of various genomic features for the viral replication cycle.

Accordingly, there remains a need for a systematic approach to generating attenuated live viruses that have practically no possibility of reversion and thus provide a fast, efficient, and safe method of manufacturing a vaccine.

Relevant background art includes PCT Application No. WO 2008121992 and Synthetic Biology: Advances in Molecular Biology and Medicine, edited by Robert Allen Meyers, pages 590-618, 2015.

SUMMARY OF THE INVENTION

According to some embodiments of the invention, there is provided an attenuated form of a virulent virus comprising an RNA encoding a viral protein or a nucleic acid sequence transcribable to the RNA, wherein the folding energy or structure of the RNA is changed at positions of evolutionarily conserved RNA structure with respect to that of the RNA encoding the viral protein in the virulent virus so as to bring about attenuation of the virus.

According to some embodiments of the invention, there is provided a method of making an attenuated viral genome comprising modifying the codon usage of the protein encoding region of a genome of a virulent virus so as to encode an RNA having a sufficient change in folding energy at sites of evolutionarily conserved RNA structure so as to bring about attenuation of the viral genome.

According to some embodiments of the invention, there is provided a computing platform for determining sites of modification to generate an attenuated virus comprising:
  (a) a data-storage device storing the nucleic acid sequence of the protein coding region of the genome of virulent viruses; and
  (b) a first processing unit for determining sites of evolutionarily conserved RNA structure; and
  (c) a second processing unit for determining a modification to the nucleic acid sequence which brings about a sufficient change in folding energy to attenuate the virus without changing the amino acid sequence of the coding region of the genome of the virulent virus.

According to some embodiments of the invention, there is provided a method of making an attenuated virus comprising inserting an attenuated viral generated according to the methods described herein into a host organism, thereby generating the attenuated virus.

According to some embodiments of the invention, there is provided a vaccine comprising the virus described herein and a pharmaceutically acceptable carrier.

According to some embodiments of the invention, there is provided a method for eliciting a protective immune response in a subject comprising administering to the subject a prophylactically or therapeutically effective dose of the vaccine described herein, thereby eliciting a protective immune response in the subject.

According to some embodiments of the invention, there is provided a method of immunizing a subject against a virus-associated disease comprising administering to the subject a prophylactically effective dose of the vaccine described herein, thereby immunizing the subject against the virus-associated disease.

According to some embodiments of the invention, the positions comprise at least 3 positions.

According to some embodiments of the invention, the viral protein is encoded by an amino acid sequence which is identical to the amino acid sequence encoded by the corresponding RNA of the virulent virus.

According to some embodiments of the invention, the virulent virus is a natural isolate.

According to some embodiments of the invention, the virulent virus is a mutant of a natural isolate.

According to some embodiments of the invention, the RNA is less than 90% identical to the corresponding RNA of the virulent virus.

According to some embodiments of the invention, the RNA is less than 80% identical to the corresponding RNA of the virulent virus.

According to some embodiments of the invention, the untranslated region of the RNA is identical to the untranslated region of the corresponding RNA of the virulent virus.

According to some embodiments of the invention, the virus infects an animal or a plant.

According to some embodiments of the invention, the animal is a human.

According to some embodiments of the invention, the virus induces a protective immune response in an animal host.

According to some embodiments of the invention, the RNA encodes more than one protein.

According to some embodiments of the invention, the viral protein is a capsid protein.

According to some embodiments of the invention, the virus is selected from the group consisting of dengue virus, poliovirus, rhinovirus, influenza virus, severe acute respiratory syndrome (SARS) coronavirus, Human Immunodeficiency Virus (HIV), Hepatitis C Virus (HCV), infectious bronchitis virus, Ebolavirus, Marburg virus, West Nile disease virus, Epstein-Barr virus (EBV) and yellow fever virus.

According to some embodiments of the invention, the virus is a flavivirus.

According to some embodiments of the invention, the flavivirus is a dengue virus.

According to some embodiments of the invention, the dengue virus is selected from the group consisting of dengue virus type 1, dengue virus type 2, dengue virus type 3 and dengue virus type 4.

According to some embodiments of the invention, the genome is encoded by a sequence selected from the group consisting of SEQ ID NOs: 1671-1734.

According to some embodiments of the invention, the virus is a retrovirus.

According to some embodiments of the invention, the retrovirus is human immunodeficiency virus (HIV).

According to some embodiments of the invention, the modifying the codon usage is effected by computationally selecting and exchanging codons encoding the same amino acid at sites of evolutionarily conserved RNA structure and computationally determining whether folding energy at the sites is changed by the exchanging.

According to some embodiments of the invention, the selecting and exchanging is repeated until the folding energy is changed by a predetermined level.

According to some embodiments of the invention, the selecting and exchanging is repeated until the folding energy is changed by a predetermined level at a predetermined number of positions.

According to some embodiments of the invention, the attenuated virus induces a substantially similar immune response in a host animal as the corresponding wild type virus.

According to some embodiments of the invention, the vaccine further comprises an adjuvant.

According to some embodiments of the invention, the subject has been exposed to a pathogenic virus.

According to some embodiments of the invention, the method further comprises administering to the subject at least one adjuvant.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

Implementation of the method and/or system of embodiments of the invention can involve performing or completing selected tasks manually, automatically (preferably computationally), or a combination thereof. Moreover, according to actual instrumentation and equipment of embodiments of the method and/or system of the invention, several selected tasks could be implemented by hardware, by software or by firmware or by a combination thereof using an operating system.

For example, hardware for performing selected tasks according to embodiments of the invention could be implemented as a chip or a circuit. As software, selected tasks according to embodiments of the invention could be implemented as a plurality of software instructions being executed by a computer using any suitable operating system.

In an exemplary embodiment of the invention, one or more tasks according to exemplary embodiments of method and/or system as described herein are performed by a data processor, such as a computing platform for executing a plurality of instructions. Optionally, the data processor includes a volatile memory for storing instructions and/or data and/or a non-volatile storage, for example, a magnetic hard-disk and/or removable media, for storing instructions and/or data. Optionally, a network connection is provided as well. A display and/or a user input device such as a keyboard or mouse are optionally provided as well.

BRIEF DESCRIPTION OF THE SEVERAL VIEWS OF THE DRAWINGS

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 1A-E illustrate methods for identifying locations which overlap with evolutionary significant folding related signals which may be used for generating attenuated viruses according to embodiments of the present invention. FIG. 1A is a flow diagram illustrating how important secondary structures were identified on an example of Dengue virus. The method includes the following general steps (details are in the main text: I. Coding regions of 1,670 Dengue genomes from 4 different serotypes were collected. II. The coding regions were aligned. III. Each of the wild type sequences was randomized 1000 times based on two different randomization models (evolutionary, and dinucleotide constrained). IV. Local folding energy (FE) profiles were predicted for each wild type and randomized sequences separately. V. Profiles of sequence variability along the aligned coding regions were computed. VI. Wild type and randomized FE profiles were compared to identify positions suspected to have a strong/weak local folding signal (p-value<0.05). VII. Positions with FE signals significantly conserved across different viral variants were identified. FIG. 1B. Evolutionary-constrained randomization model—synonymous codons in each column in multiple alignment were permuted; if more than one amino acid was present (different colors) the permutations were restricted to the corresponding sets of synonymous codons. FIG. 1C. Prediction of FE in 39 nt windows (red arrow) along the coding sequence (brown); green arrow—44 nt sequence interval corresponding to signal conservation and sequence variability analyses (the size of the interval was determined by the FE prediction window size+allowed shift in signal position in conservation analysis). FIG. 1D. One-Versus-Rest (OVR) model—in each randomized variant, randomized FE signals were identified by a position-wise comparison to the rest of the randomized variants from the same wild-type origin. FIG. 1E. Signals conservation—suspected FE related signals (yellow) were defined as conserved if they appear in a significantly high (p-value<0.001 with respect to randomized conservation levels based on OVR randomized signals) number of different sequences within a 5 nt vicinity to each other (red). Two different clusters, each one consisting of two positions with a conserved FE related signal are illustrated (distinguished by vertical dot lines); by definition, positions belong to the same cluster if they correspond to 44 nt length partially—overlapping genomic windows.

Figure 2A:
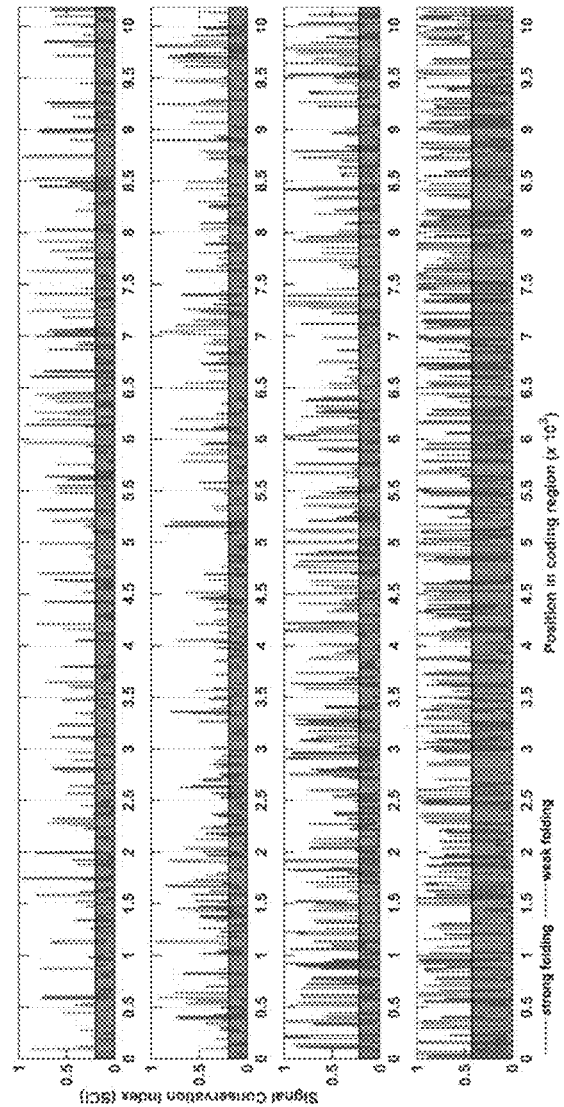
Figure 2B:
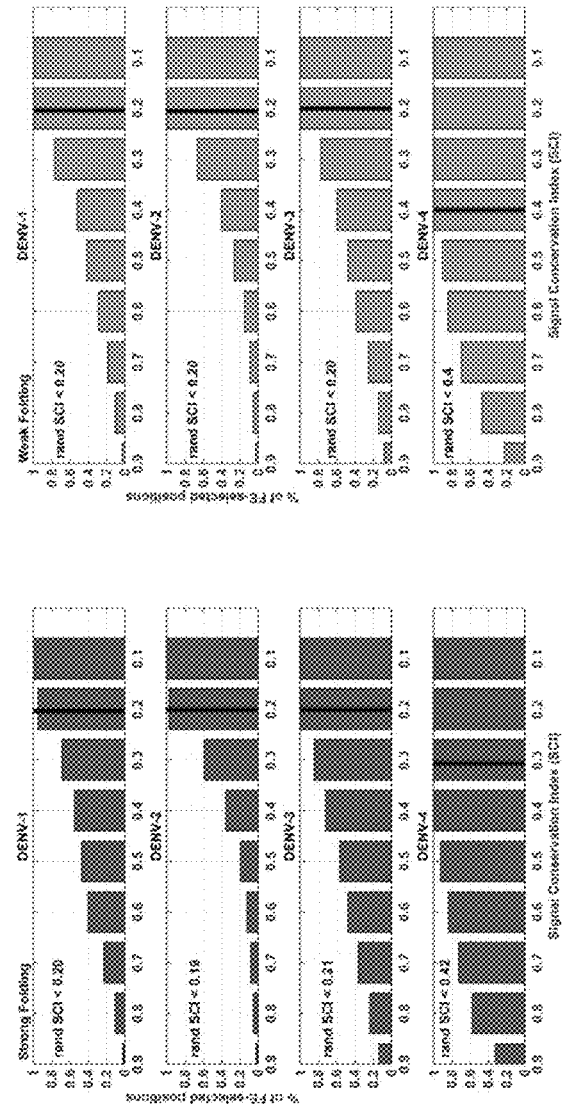

FIGS. 2A-B. A. Profiles of FE related signal conservation along the coding regions of 4 DENV serotypes for strong (red) and weak (green) folding. Positions with FSCI higher than a maximal value achieved in random (which is denoted by the shadowed area and is very similar for strong and weak folding) are not expected to be obtained by chance (p-value<0.001 with respect to FSCI values based on randomized signals; Benjamini-Hochberg fdr=0.001) and are defined as positions which may undergo a conserved selection for strong/weak local folding energy (shortly, minimum free folding energy (MFE)-selected). B. Distribution of FSCI values in MFE-selected positions for strong/weak folding in 4 serotypes. The maximal FSCI values achieved in random are explicitly annotated (rand SCI) and marked by black vertical bars. Total number of MFE-selected positions in wild-type is 40-100 folds higher than in random.

Figure 3:
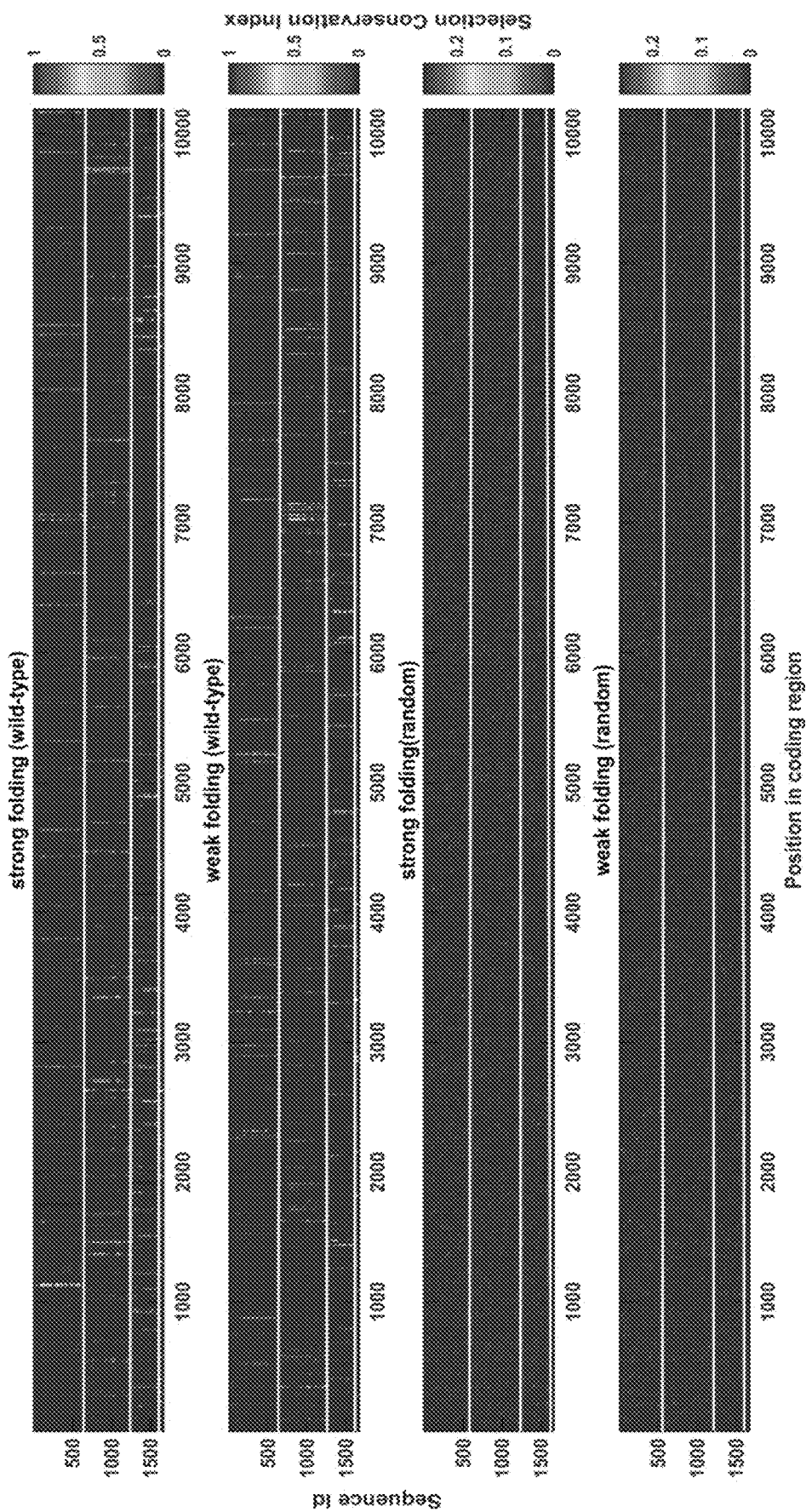

FIG. 3. Selection matrices for strong/weak folding for wild-type and one corresponding randomized variant in 4 DENV serotypes. Each row in the matrix corresponds to one sequence; columns are positions along the coding region. If sequence i has a suspected minimum free folding energy (MFE) related signal (p-value<0.05) in position j, the entry (i,j) has a value equal to the corresponding folding signal conservation index (FSCI); otherwise it is equal to zero. White horizontal lines separate between sequences belonging to different serotypes (serotypes are ordered from top to bottom, i.e. sequences 1-652 belong to serotype 1; 653-1268 to serotype 2; 1269-1625 to serotype 3 and 1626-1670 to serotype 4). We can clearly distinguish positions with conserved MFE related signals with different conservation levels in the wild-type, contrasting with a white noise resembling appearance in the randomized variants.

Figure 4A:
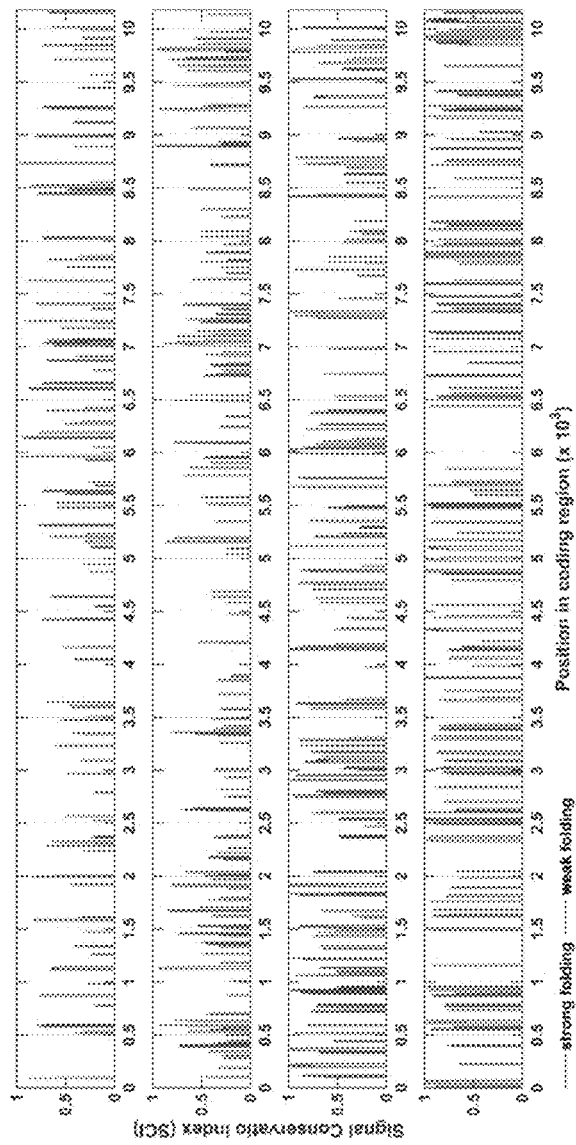
Figure 4B:
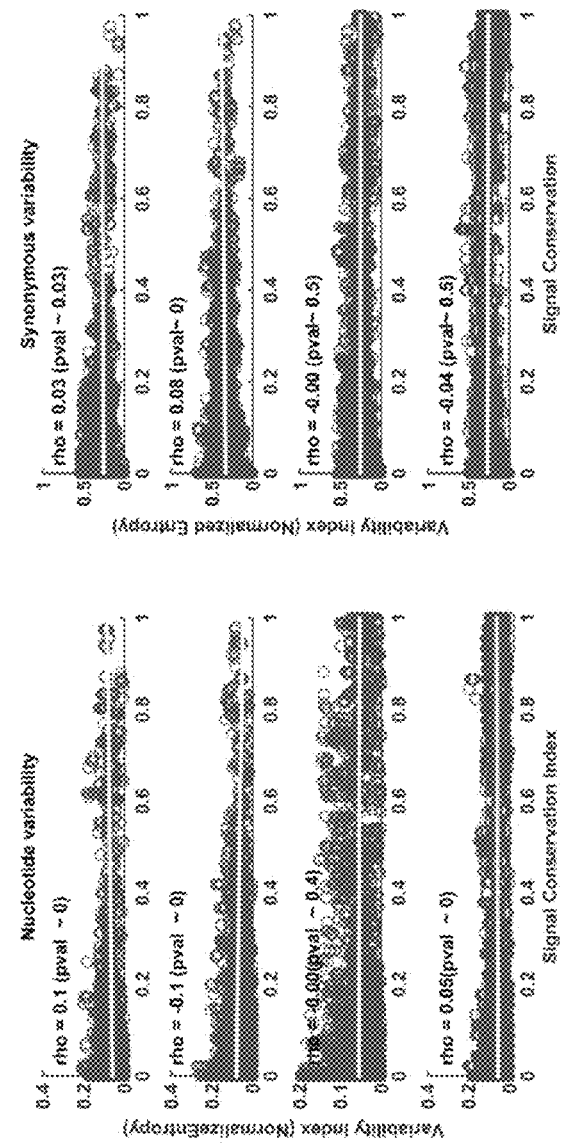

FIGS. 4A-B: A. Conserved selection for strong/weak folding related signals cannot be explained basing only on dinucleotide composition. As many as 60%, 52%, 49%, 34% of positions with conserved signals related to strong folding (red) and 62%, 58%, 43%, 44% of positions possessing weak folding signal conservation (green) (for serotypes 1-4 correspondingly) overlapped with MFE conserved signals identified with respect to dinucleotide-constrained randomization model, and this overlap was not likely to appear in random (p-value<0.001; no overlap was observed in 1000 randomized variants). B. The regions with significantly conserved strong/weak folding signal cannot be explained based only on sequence conservation. A low/insignificant Spearman correlation between conservation levels of MFE related signals and the nucleotide/synonymous variability in the corresponding genomic intervals.

Figure 5:
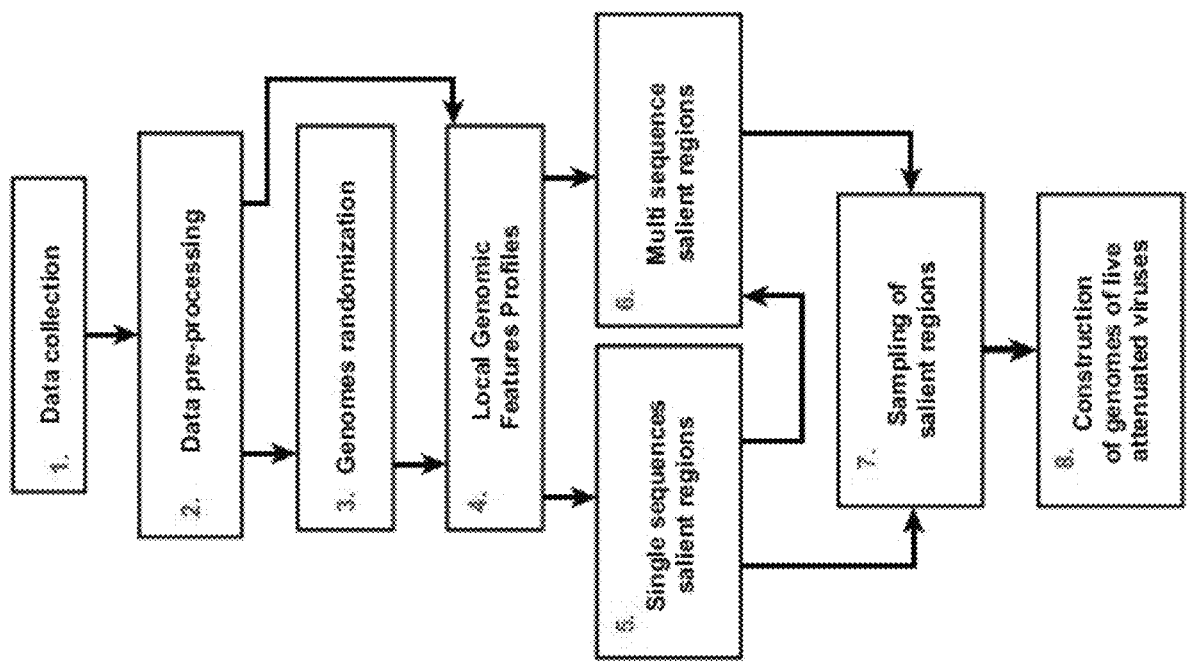

FIG. 5 is a flow diagram summarizing how attenuated viruses may be generated according to embodiments of the present invention. 1. Viral genomic sequences are collected from available resource. 2. The collected sequences are pre-processed: e.g., aligned and sub-sampled. 3. Each of the wild type sequences is randomized N times based on one or several biologically motivated randomization models. 4. Local genomic features (LGF) profiles are predicted for each wild type and random sequence separately. 5, 6. Wild type and randomized LGF profiles are compared to identify evolutionary salient local regions based on a single (5) or multiple (6) sequences. 7. K top salient regions are sampled according to their significance rank. 8. The resulting salient regions are mutated to construct the genome of live attenuated virus.

Figure 6A:
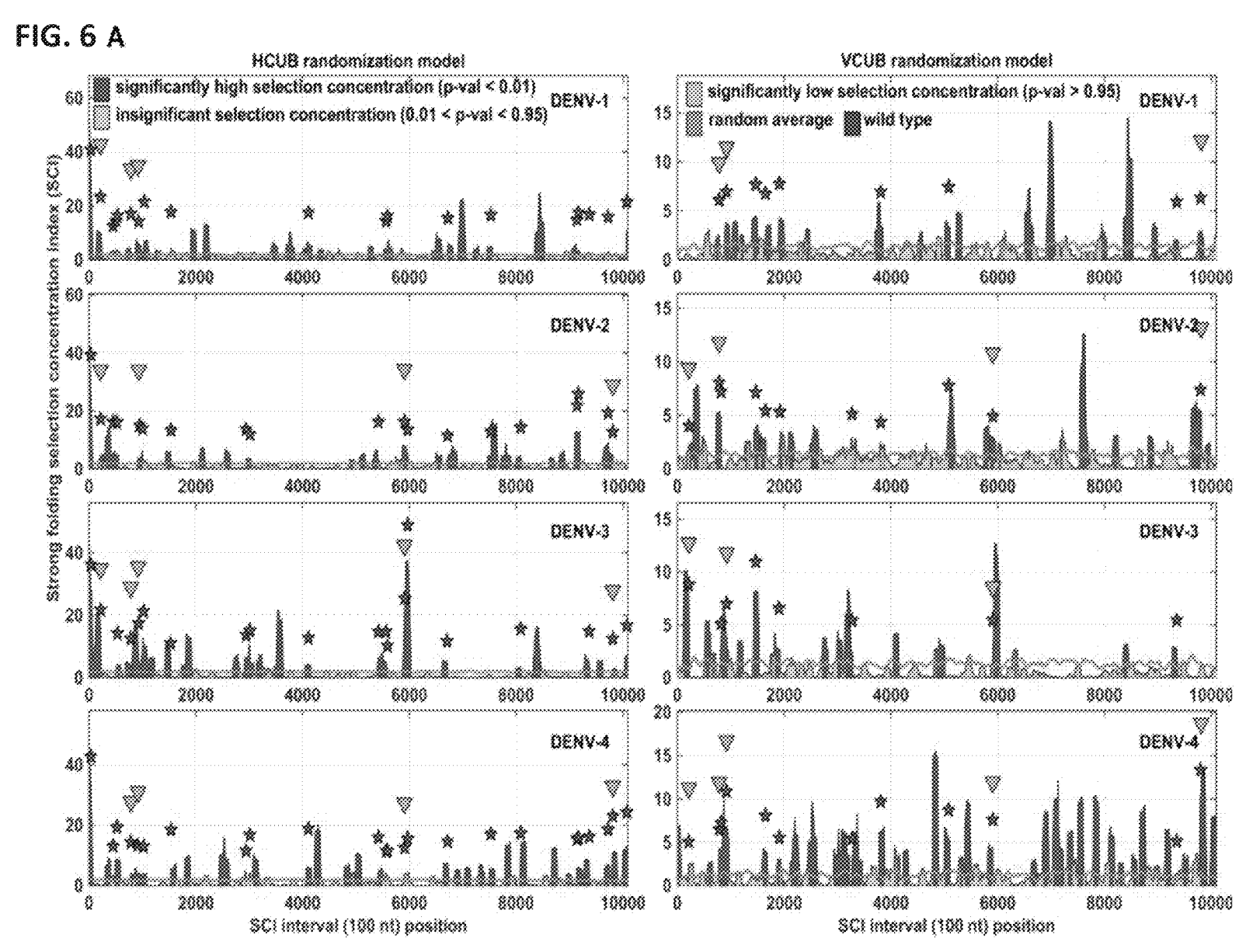
Figure 6B:
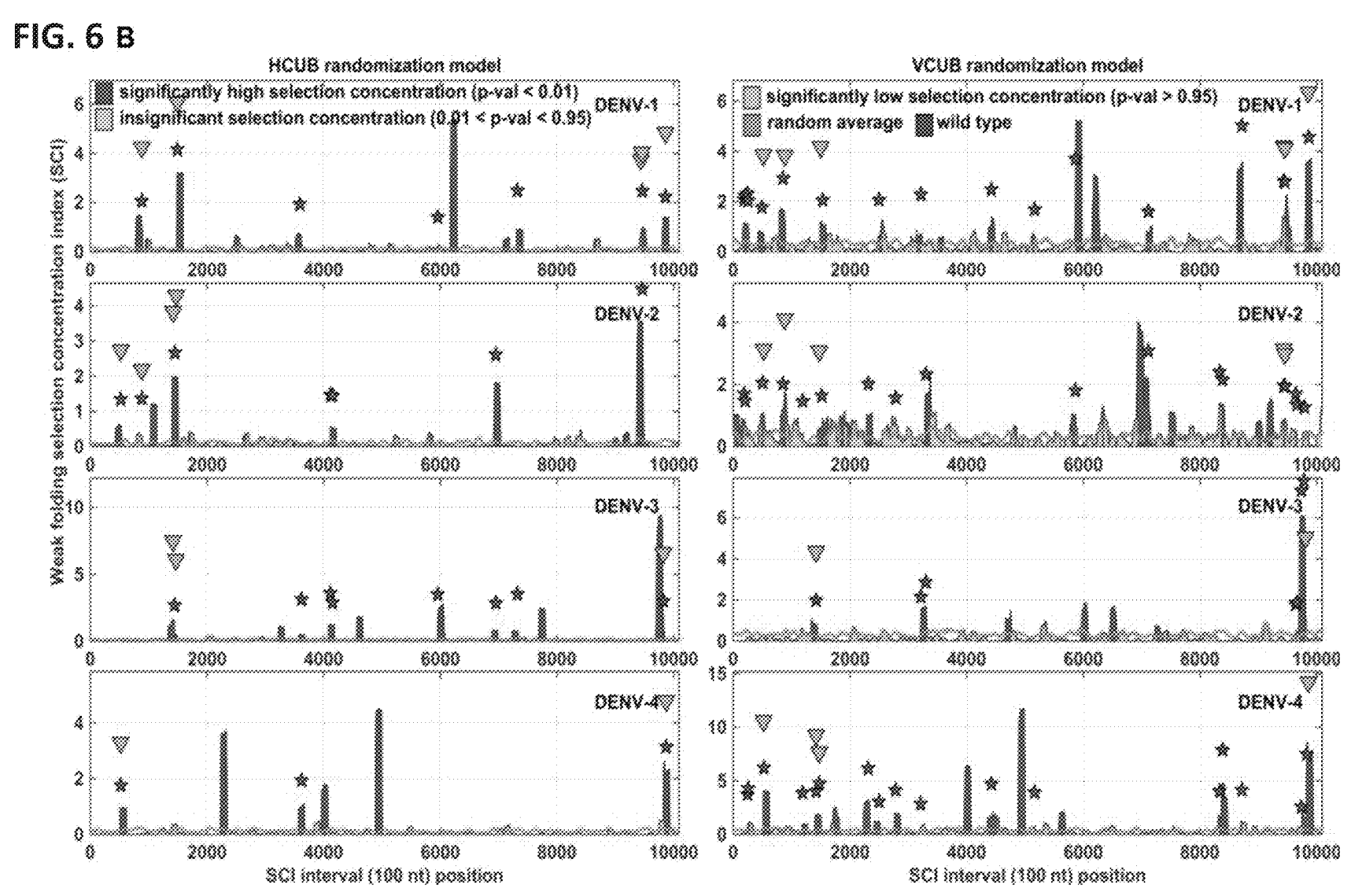

FIGS. 6A-B illustrate the selection concentration profiles of positions selected for strong/weak folding energy in coding regions of 4 Dengue virus serotypes. Selection concentration profiles (SCI-intervals of size 100) for serotypes 1-4 for strong (A) and weak (B) folding based on HCUB/VCUB randomization models: red—concentration intervals (p-values<0.01); blue—non-significant SCI-intervals (0.01<p-value<0.95); orange—SCI-intervals with significantly low SCI values (p-value>0.95); green—randomized selection concentration profile averaged over all randomized variants corresponding to all sequences in each serotype separately. Clusters of 100 nt concentration intervals (red), where the average number of positions selected for folding strength (weak or strong) is significantly higher than in random (p-value<0.01), are scattered all over the coding region. The number of salient regions in these clusters is on average ~3-20 times higher than in the corresponding randomized selection concentration profiles. The described concentrations of salient regions are not expected to appear in random, where salient regions are distributed almost uniformly over the coding region. Clusters which appear in at least 3 serotypes for strong folding and at least 2 serotypes for weak folding, with respect to the same random model (HCUB or VCUB), are marked with red pentagrams; clusters which appear in at least 3 serotypes for strong folding and at least 2 serotypes for weak folding, with respect to both random models (HCUB and VCUB), are marked by cyan triangles.

FIG. 7 illustrates the construction of genomes of live attenuated viruses by modifying the coding sequence in regions with a conserved selection for strong/weak folding: I. Salient regions in the wild type sequence, evolutionary selected to have a significantly strong/weak mRNA folding, are identified (See FIGS. 1A-E). II. Each one of the regions selected for strong folding is mutated in turn to have the weakest folding possible subjected to maintaining the encoded protein and the codon usage bias; each one of the regions selected for weak folding is mutated in turn to have the strongest folding possible subjected to maintaining the encoded protein and the codon usage bias; parts outside the mutated regions are not modified. The corresponding genomes of live attenuated viruses contain a mutated region (one mutated region per variant) and the rest of the sequence identical to the wild-type; other variants may contain compositions of several mutated regions and the rest of the sequence identical to the wild-type. III. Each live attenuated genome is replicated, at the beginning in corresponding cell lines and later in model organisms. III. Their replication rate is analyzed.

Figure 8B:
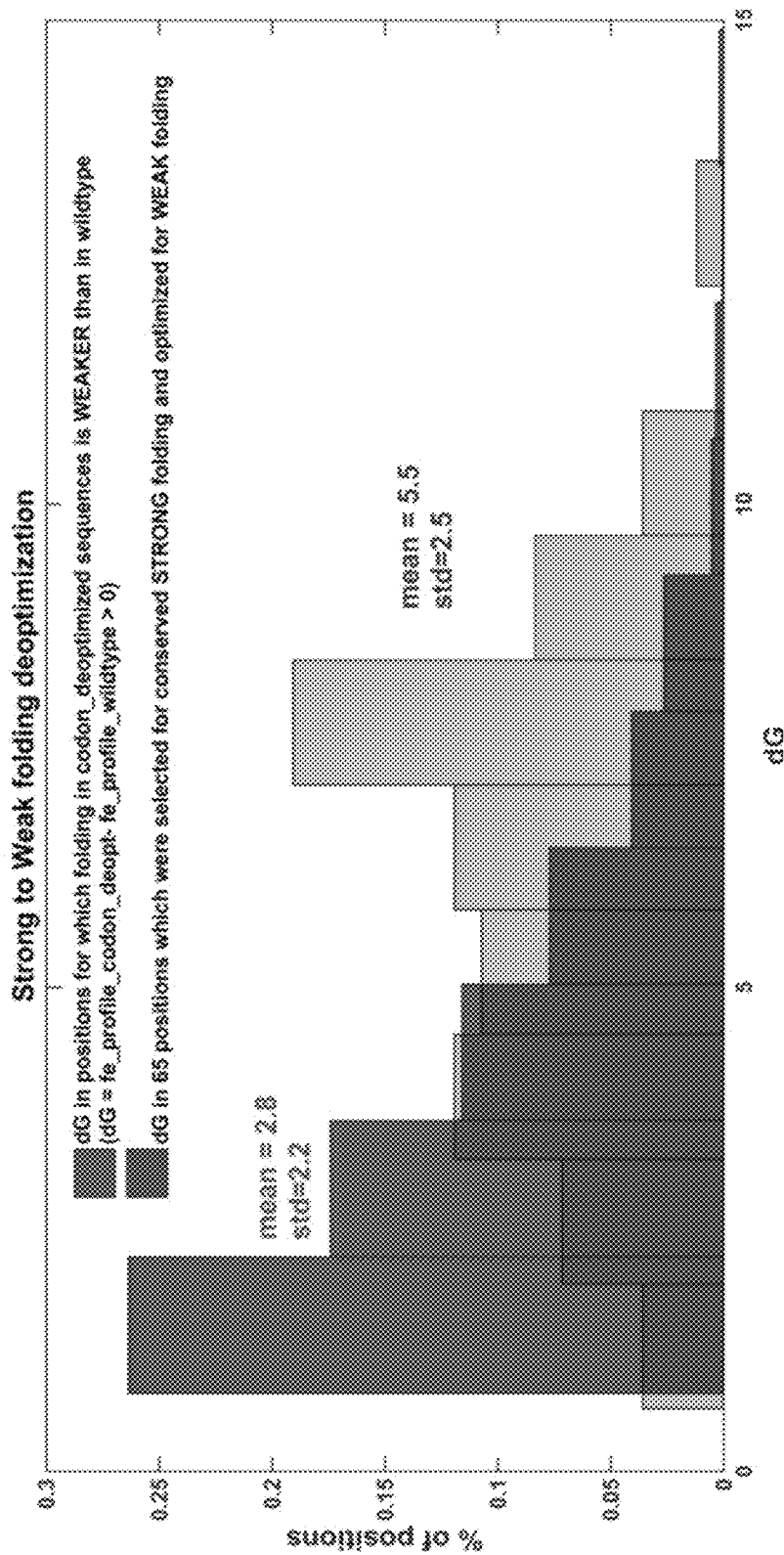

FIGS. 8A-B are graphs comparing the minimum free folding energy ($\Delta G$) distributions for folding deoptimized and codon-pair deoptimized sequences. A. Strong to weak folding deoptimization: red—$\Delta G$ distribution in positions for which folding in codon pair deoptimized sequence is stronger than in wildtype; blue—$\Delta G$ distribution in 73 selected windows (with respect to weak folding) which have deoptimized to have strong folding. B. Weak to strong folding deoptimization. red—$\Delta G$ distribution in positions for which folding in codon pair deoptimized sequence is weaker than in wildtype; blue—$\Delta G$ distribution in 65 selected windows (with respect to strong folding) which have deoptimized to have weak folding.

DESCRIPTION OF SPECIFIC EMBODIMENTS OF THE INVENTION

The present invention, in some embodiments thereof, relates to an attenuated virus comprising a modified viral genome containing a plurality of nucleotide substitutions. The nucleotide substitutions result in the exchange of codons for other synonymous codons so as to bring about a change in the structure at multiple sites of evolutionarily conserved structures in the viral genome.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

Viruses undergo a rapid evolutionary selection to evade the host immune systems, and to efficiently compete with endogenous transcripts of the host cell over the gene expression machinery. Mechanisms that facilitate efficient and selective viral replication are inherent in the nucleotide composition of the viral genomic sequence itself, and can involve the recruitment and/or modification of specific host factors.

Non-synonymous mutations which alter the amino acid sequence provide a distinct evolutionary advantage due to selective pressure, allowing viruses to escape from innate defense mechanisms and acquired immune surveillance of the host, and to rapidly adapt to new cell types, tissues, or species. Yet, genomes (and even coding sequences), both viral and of other organisms, not only code for protein products but also carry additional information encrypted in the composition of alternating codons.

This information can be induced by synonymous mutations which preserve the underlying protein; being related to different biophysical and evolutionary characteristics, it may play an important regulatory role in different viral replication stages.

The present inventors aligned coding regions of different genomes from four DENV serotypes. Next, they designed randomized variants (a Null model) in silico, that preserved the amino acid order of the wild type sequences and further ensured that both the column-wise frequencies of synonymous codons at each position along their alignment and the distribution of frequencies of pairs of adjacent nucleotides (dinucleotides-constrained model) were maintained. They computed local folding energy profiles (FE-profiles) for each wild-type and randomized sequence. Using this approach, the present inventors identified hundreds of positions along the DENV coding regions that were selected during the course of viral evolution for significantly strong/weak folding (more/less negative FE). The present inventors reasoned that such positions may belong to functional elements (i.e. elements conserved in various genomes with respect to their function but not necessarily conserved with respect to their sequence) and therefore could have important implications for viral fitness.

The present inventors propose that altering the structure of viral RNA, by performing synonymous mutations at the identified locations would enable the altering of gene expression in a controllable way and eventually regulate the viral replication without affecting the encoded proteins. Accordingly the exemplified method can be used to design attenuated viruses that are too weak to cause illness but viable enough to replicate sufficiently and stimulate a robust immune response.

Thus, according to a first aspect of the present invention there is provided an attenuated form of a virulent virus comprising an RNA encoding a viral protein or a nucleic acid sequence transcribable to the RNA, wherein the folding energy or structure of the RNA is changed at positions of evolutionarily conserved structure with respect to that of the RNA encoding the viral protein in the virulent virus so as to bring about attenuation of the virus.

Any virus can be attenuated by the methods disclosed herein. The virus can be a dsDNA virus (e.g. Adenoviruses, Herpesviruses, Poxviruses), a single stranded "plus" (or positive) sense DNA virus (e.g., Parvoviruses) a double stranded RNA virus (e.g., Reoviruses), a single stranded+(or positive) sense RNA virus (e.g. Dengue virus, Picornaviruses, Togaviruses), a single stranded "minus" (or negative) sense RNA virus (e.g. Orthomyxoviruses, Rhabdoviruses), a single stranded+(or positive) sense RNA virus with a DNA intermediate (e.g. Retroviruses), or a double stranded reverse transcribing virus (e.g. Hepadnaviruses), or single stranded reverse transcribing virus (e.g. HIV).

According to a particular embodiment, the virus is a flavivirus.

Below is a non-limiting list of flaviviruses contemplated for attenuation according to embodiments of the present invention:

Tick-Borne Viruses:

Mammalian Tick-Borne Virus Group

Absettarov virus, Alkhurma virus (ALKV), Deer tick virus (DT), Gadgets Gully virus (GGYV), Kadam virus (KADV), Karshi virus, Kyasanur Forest disease virus (KFDV), Langat virus (LGTV), Louping ill virus (LIV), Omsk hemorrhagic fever virus (OHFV), Powassan virus (POWV), Royal Farm virus (RFV), Sokuluk virus (SOKV), Tick-borne encephalitis virus (TBEV), Turkish sheep encephalitis virus (TSE)

Seabird Tick-Borne Virus Group

Kama virus (KAMV), Meaban virus (MEAV), Saumarez Reef virus (SREV) and Tyuleniy virus (TYUV).

Mosquito-Borne Viruses:

Without Known Vertebrate Host:

*Aedes* flavivirus, Barkedji virus, Calbertado virus, Cell fusing agent virus, Chaoyang virus, *Culex* flavivirus, *Culex theileri* flavivirus, Donggang virus, Ilomantsi virus, Kamiti River virus, Lammi virus, Marisma mosquito virus, Nakiwogo virus, Nhumirim virus, Nounane virus, Spanish *Culex* flavivirus, Spanish Ochlerotatus flavivirus, Quang Binh virus Aroa Virus Group:

Aroa virus (AROAV), Bussuquara virus

Dengue Virus Group:

Dengue virus (DENV), Kedougou virus (KEDV)

Japanese Encephalitis Virus Group:

Bussuquara virus, Cacipacore virus (CPCV), Koutango virus (KOUV), Ilheus virus (ILHV), Japanese encephalitis virus (JEV), Murray Valley encephalitis virus (MVEV), Alfuy virus, Rocio virus (ROCV), St. Louis encephalitis virus (SLEV), Usutu virus (USUV), West Nile virus (WNV), Yaounde virus (YAOV)

Kokobera Virus Group:

Kokobera virus (KOKV)

Ntaya Virus Group:

Bagaza virus (BAGV), Baiyangdian virus (BYDV), Duck egg drop syndrome virus (BYDV), Ilheus virus (ILHV), Jiangsu virus (JSV), Israel turkey meningoencephalomyelitis virus (ITV), Ntaya virus (NTAV), Tembusu virus (TMUV), Spondweni virus group, Zika virus (ZIKV), Yellow fever virus group, Banzi virus (BANV), Bouboui virus (BOUV), Edge Hill virus (EHV), Jugra virus (JUGV), Saboya virus (SABV), Sepik virus (SEPV), Uganda S virus (UGSV), Wesselsbron virus (WESSV) and Yellow fever virus (YFV)

Entebbe Virus Group:

Entebbe bat virus (ENTV), Yokose virus (YOKV)

Modoc Virus Group:

Apoi virus (APOIV), Cowbone Ridge virus (CRV), Jutiapa virus (JUTV), Modoc virus (MODV), Sal Vieja virus (SVV) and San Perlita virus (SPV)

Rio Bravo Virus Group:

Bukalasa bat virus (BBV), Carey Island virus (CIV), Dakar bat virus (DBV), Montana *myotis* leukoencephalitis virus (MMLV), Phnom Penh bat virus (PPBV) and Rio Bravo virus (RBV).

According to one embodiment, the virus is one of the four serotypes that cause Dengue fever (dengue virus type 1, dengue virus type 2, dengue virus type 3, and dengue virus type 4).

Nucleic acid sequences of the DNA sequence encoding the genome of the wild-type dengue virus type 1 are provided in SEQ ID NOs: 1-652.

Nucleic acid sequences of the DNA sequence encoding the genome of the wild-type dengue virus type 2 are provided in SEQ ID NOs: 653-1268.

Nucleic acid sequences of the DNA sequence encoding the genome of the wild-type dengue virus type 3 are provided in SEQ ID NOs: 1269-1625.

Nucleic acid sequences of the DNA sequence encoding the genome of the wild-type dengue virus type 4 are provided in SEQ ID NOs: 1626-1670.

In certain non-limiting embodiments of the present invention, the virus is poliovirus (PV), rhinovirus, influenza virus including avian flu (e.g. HSN1 subtype of influenza A virus), severe acute respiratory syndrome (SARS) coronavirus, Human Immunodeficiency Virus (HIV), Hepatitis B Virus (HBV), Hepatitis C Virus (HCV), infectious bronchitis virus, ebolavirus, Marburg virus, dengue fever virus (Flavivirus serotypes), West Nile disease virus, Epstein-Barr virus (EBV), yellow fever virus, Ebola (ebolavirus), chickenpox (varicella-zoster virus), measles (a paramyxovirus), mumps (a paramyxovirus), rabies (Lyssavirus), human papillomavirus, Kaposi's sarcoma-associated herpesvirus, Herpes Simplex Virus (HSV Type 1), or genital herpes (HSV Type 2). Other examples of viruses contemplated by the present invention are those disclosed in WO 2008121992, the contents of which are incorporated herein by reference.

In various embodiments, the attenuated virus belongs to the delta virus family and all related genera.

In various embodiments, the attenuated virus belongs to the Adenoviridae virus family and all related genera, strains, types and isolates for example but not limited to human adenovirus A, B, C.

In various embodiments, the attenuated virus belongs to the Herpesviridae virus family and all related genera, strains, types and isolates for example but not limited to herpes simplex virus.

In various embodiments, the attenuated virus belongs to the Reoviridae virus family and all related genera, strains, types and isolates.

In various embodiments, the attenuated virus belongs to the Papillomaviridae virus family and all related genera, strains, types and isolates.

In various embodiments, the attenuated virus belongs to the Poxviridae virus family and all related genera, strains, types and isolates.

In various embodiments, the attenuated virus belongs to the Retroviridae virus family and all related genera, strains, types and isolates. For example, but not limited to Human Immunodeficiency Virus.

In various embodiments, the attenuated virus belongs to the Filoviridae virus family and all related genera, strains, types and isolates.

In various embodiments, the attenuated virus belongs to the Paramyxoviridae virus family and all related genera, strains, types and isolates.

In various embodiments, the attenuated virus belongs to the Orthomyxoviridae virus family and all related genera, strains, types and isolates.

In various embodiments, the attenuated virus belongs to the Picornaviridae virus family and all related genera, strains, types and isolates.

In various embodiments, the attenuated virus belongs to the Bunyaviridae virus family and all related genera, strains, types and isolates.

In various embodiments, the attenuated virus belongs to the Nidovirales virus family and all related genera, strains, types and isolates.

In various embodiments, the attenuated virus belongs to the Caliciviridae virus family and all related genera, strains, types and isolates.

In other embodiments, the attenuated virus may be used as a non-pathogenic viral vectors for plant transformation.

The virulent virus (from which the attenuated virus is directly or non-directly derived) may be a "wild type" or "naturally occurring" prototype or isolate of variants. However, parent viruses also include mutants specifically created or selected in the laboratory on the basis of real or perceived desirable properties. Accordingly, parent viruses that are candidates for attenuation include mutants of wild type or naturally occurring viruses that have deletions, insertions, amino acid substitutions and the like, and also include mutants which have codon substitutions. In one embodiment, such a parent sequence differs from a natural isolate by about 30 amino acids or fewer. In another embodiment, the parent sequence differs from a natural isolate by about 20 amino acids or fewer. In yet another embodiment, the parent sequence differs from a natural isolate by about 10 amino acids or fewer.

As used herein, the term "attenuated virus" refers to a virus, in which the virulence thereof has been reduced, e.g. by genetic manipulation of the viral genome.

In one embodiment, the attenuated virus is a live virus.

In another embodiment, the attenuated virus is a dead e.g. killed virus (i.e. not capable of replication).

Preferably, the virulence of the virus has been reduced by at least 5 fold, 10 fold or even greater. Viral attenuation can be confirmed in ways that are well known to one is of ordinary skill in the art. Non-limiting examples induce plaque assays, growth measurements, and reduced lethality in test animals.

The attenuation of the virus pertains to its virulence (pathogenicity), but does not necessarily affect the replicative capability of a virus. An attenuated virus can still be capable of replication. Thus, it may be a strain of a virus whose pathogenicity has been reduced so that it will initiate the immune response without causing the specific disease.

As mentioned, an RNA (or a DNA which transcribes to the RNA) of the attenuated virus of this aspect of the present invention is genetically modified such that there is a change in folding energy (e.g. local folding energy) or structure of the RNA of the protein encoding region thereof at positions which have been shown to display evolutionarily conserved RNA structure.

According to this aspect of the present invention, the phrase "evolutionarily conserved structure" refers to a structure/or lack thereof, being present in at least 10%, 20%, 30%, 40%, 50%, 60%, 70%, 80%, 90%, 91%, 92%, 93%, 94%, 95%, 96%, 97%, 98%, 99% or 100% of the known serotypes, genotypes, strains, variants or isolates of a particular virus. Specifically, the % of the strain can be chosen such that the signal will be statistically significant based on an appropriate null model.

In one embodiment, the evolutionarily conserved RNA structure refers to a general secondary structure and not to a specific structure per se.

In another embodiment, the evolutionarily conserved RNA structure refers to the presence of a particular structure (e.g. a hairpin structure, a stem and/or a loop).

In another embodiment, the evolutionarily conserved RNA structure refers to the absence of a secondary structure.

It will be appreciated that when there is a change in structure, there may or may not be a change in folding energy. However, when there is a change in folding energy, this is typically always associated with a change of structure.

Preferably, the RNA (or DNA encoding same) is modified at protein-coding bases. In one embodiment, only the protein-coding bases are modified such that the untranslated region of the RNA is identical to the untranslated region of the corresponding RNA of the virulent virus.

The modifications contemplated by the present inventors may be any modification that results in a reduction of virulence of the virus, including for example substitutions, insertions and deletions. The modifications may be synonymous or non-synonymous.

According to one embodiment, the modification is such that the amino acid sequence of the protein encoded by the RNA is at least 95% identical to the amino acid sequence of the protein of the wild-type, virulent virus.

According to one embodiment, the modification is such that the amino acid sequence of the protein encoded by the RNA is at least 96% identical to the amino acid sequence of the protein of the wild-type, virulent virus.

According to another embodiment, the modification is such that the amino acid sequence of the protein encoded by the RNA is at least 97% identical to the amino acid sequence of the protein of the wild-type, virulent virus.

According to yet another embodiment, the modification is such that the amino acid sequence of the protein encoded by the RNA is at least 98% identical to the amino acid sequence of the protein of the wild-type, virulent virus.

According to still another embodiment, the modification is such that the amino acid sequence of the protein encoded by the RNA is at least 99% identical to the amino acid sequence of the protein of the wild-type, virulent virus.

According to another embodiment, the modification is such that the amino acid sequence of the protein encoded by the RNA is 100% identical to the amino acid sequence of the protein of the wild-type, virulent virus.

Preferably the RNA of the attenuated virus is less than 90%, 85%, 80%, 75% or even 70% identical to the corresponding RNA of the virulent virus.

In one embodiment, the proteins encoded by the modified attenuated virus differ from the wild-type (virulent) virus by about 20 amino acids, 10 amino acids, five amino acids or fewer.

In one embodiment, the modification results in a conservation substitution in the encoded protein of the RNA.

The term "conservative substitution" as used herein, refers to the replacement of an amino acid present in the native sequence of the protein with a naturally occurring amino acid having similar steric properties. Where the side-chain of the native amino acid to be replaced is either polar or hydrophobic, the conservative substitution should be with a naturally occurring amino acid which is also polar or hydrophobic (in addition to having the same steric properties as the side-chain of the replaced amino acid).

As naturally occurring amino acids are typically grouped according to their properties, conservative substitutions by naturally occurring amino acids can be easily determined bearing in mind the fact that in accordance with the invention replacement of charged amino acids by sterically similar non-charged amino acids are considered as conservative substitutions.

When affecting conservative substitutions the substituting amino acid should have the same or a similar functional group in the side chain as the original amino acid.

In another embodiment, the modification results in a non-conservation substitution in the encoded protein of the RNA.

The phrase "non-conservative substitutions" as used herein refers to replacement of the amino acid as present in the parent sequence by another naturally or non-naturally occurring amino acid, having different electrochemical and/or steric properties. Thus, the side chain of the substituting amino acid can be significantly larger (or smaller) than the side chain of the native amino acid being substituted and/or can have functional groups with significantly different electronic properties than the amino acid being substituted. Examples of non-conservative substitutions of this type include the substitution of phenylalanine or cyclohexylmethyl glycine for alanine, isoleucine for glycine, or —NH—CH[(—CH$_2$)$_5$—COOH]—CO— for aspartic acid. Those non-conservative substitutions which fall under the scope of the present invention are those which still constitute a protein that induces an immunogenic response in a subject but does not cause virulence.

According to a particular embodiment, the substitution is a synonymous substitution—i.e. the substitution of at least one base for another in a region of the RNA which codes for a protein, such that the amino acid sequence of the translated protein is not modified.

"Synonymous" codons are codons that encode the same amino acid. Thus, for example, CUU, CUC, CUA, CUG, UUA, and UUG are synonymous codons that code for Leucine (Leu). Synonymous codons are not used with equal frequency. In general, the most frequently used codons in a particular organism are those for which the cognate tRNA is abundant, and the use of these codons enhances the rate and/or accuracy of protein translation. Conversely, tRNAs for the rarely used codons are found at relatively low levels, and the use of rare codons is thought to reduce translation rate and/or accuracy. Thus, to replace a given codon in a nucleic acid by a synonymous but less frequently used codon is to substitute a "deoptimized" (in terms of speed) codon into the nucleic acid.

In one embodiment, the codons of the RNA are replaced with synonymous codons while maintaining the overall codon bias of the virus. Thus, the overall the average number of rare and/or frequent codons remains the same throughout the RNA.

In another embodiment, the codons of the RNA are replaced with synonymous codons thereby altering the overall codon bias of the virus. Thus, the overall average number of rare and/or frequent codons differs from the wild-type virulent virus.

As used herein, a "rare" codon refers to one of at least two synonymous codons encoding a particular amino acid that is present in an mRNA at a significantly lower frequency than the most frequently used codon for that amino acid. Thus, the rare codon may be present for example at about a 2-fold lower frequency than the most frequently used codon. In one embodiment, the rare codon is present at least a 3-fold, more preferably at least a 5-fold, lower frequency than the most frequently used codon for the amino acid. Conversely, a "frequent" codon refers to one of at least two synonymous codons encoding a particular amino acid that is present in an mRNA at a significantly higher frequency than the least frequently used codon for that amino acid. The frequent codon may be present at about a 2-fold, preferably at least a 3-fold, more preferably at least a 5-fold, higher frequency than the least frequently used codon for the amino acid.

In one embodiment, the codons of the RNA are replaced with synonymous codons while maintaining codon pair bias of the virus. In another embodiment, the codons of the RNA are replaced with synonymous codons thereby altering the overall codon pair bias of the virus. Codon pair virus is described in WO 2008121992, the contents of which are incorporated herein by reference.

Synonymous codons are provided in Table 1 herein below. The first nucleotide in each codon encoding a particular amino acid is shown in the left-most column; the second nucleotide is shown in the top row; and the third nucleotide is shown in the right-most column.

TABLE 1

| Genetic Code | | | | | |
|---|---|---|---|---|---|
| | U | C | A | G | |
| U | Phe | Ser | Tyr | Cys | U |
| | Phe | Ser | Tyr | Cys | C |
| | Leu | Ser | STOP | STOP | A |
| | Leu | Ser | STOP | Trp | G |
| C | Leu | Pro | His | Arg | U |
| | Leu | Pro | His | Arg | C |
| | Leu | Pro | Gln | Arg | A |
| | Leu | Pro | Gln | Arg | G |
| A | Ile | Thr | Asn | Ser | U |
| | Ile | Thr | Asn | Ser | C |
| | Ile | Thr | Lys | Arg | A |
| | Met | Thr | Lys | Arg | G |
| G | Val | Ala | Asp | Gly | U |
| | Val | Ala | Asp | Gly | C |
| | Val | Ala | Glu | Gly | A |
| | Val | Ala | Glu | Gly | G |

As mentioned, the virus is modified so as to change the folding energy or structure of the RNA at positions of evolutionarily conserved structure.

The folding energy (FE) is a thermodynamic energy involved in maintaining a secondary structure available to perform physical work while being released, and thus is characterized by non-positive values. mRNA secondary structure is believed to be in the most stable conformation when a minimum amount of free folding energy is exerted (the FE obtains the most negative value). The number and strength of hydrogen bonds in RNA determine the folding energy, which is related to the folding strength of the structure: more negative FE indicates possibly stronger and more stable folding, while less negative FE corresponds to weaker and less structured conformations.

According to one embodiment, a position with weak RNA folding (less negative free energy/higher free energy) is modified to increase the RNA folding thereof (i.e. make the free energy more negative). Positions of weak folding may be defined based on a comparison to a random model that can maintain various basic properties/features of the viral genome (for example, the amino acid content/order, the codon frequencies, the di-nucleotide frequencies, or any combination of these properties/features). If the probability to see weaker folding in this position in the corresponding random genomes is lower than a certain threshold (e.g. 0.05, 0.01, 0.005, 0.001, 0.0001, 0.00001, 0.000001 or the largest p-value that pass correction for multiple hypothesis testing) the position may be defined as a position with weak folding.

According to one embodiment, a position with strong RNA folding (more negative free energy/lower free energy) is modified to decrease the RNA folding thereof (i.e. make the free energy less negative). Positions of strong folding may be defined based on a comparison to a random model that can maintain various basic properties/features of the viral genome (for example, the amino acid content/order, the codon frequencies, the di-nucleotide frequencies, or any combination of these properties/features). If the probability to see stronger folding in this position in the corresponding random genomes is lower than a certain threshold (e.g. 0.05, 0.01, 0.005, 0.001, 0.0001, 0.00001, 0.000001 or the largest p-value that pass correction for multiple hypothesis testing) the position may be defined as a position with strong folding.

For example, the following are the folding energies (average over all genomes considering 5 nt neighborhood around the location) and locations (the index of the nucleotide relatively to the 5'end/beginning of the genome) of positions with significant (p-values=0.001 and higher than maximal value observed in randomized genomes) weak/strong folding energy in the case of the second DNGV serotype (serotype 2):

Locations:

| | | | | | | | | | | | |
|---|---|---|---|---|---|---|---|---|---|---|---|
| 8893 | 8894 | 8895 | 2163 | 2164 | 8892 | 2162 | 8896 | 9808 | 9807 | 9806 | 2165 |
| | 9805 | 9809 | 8897 | 2161 | 9810 | 8891 | 8898 | 9804 | 8899 | 9718 | 9717 |
| | 7304 | 9811 | 8890 | 7305 | 9716 | 2166 | 9719 | 8900 | 9715 | 9714 | 9713 |
| | 9812 | 8889 | 2160 | 9720 | 9712 | 9803 | 6838 | 6837 | 9711 | 7303 | 8888 |
| | 6836 | 9710 | 9721 | 7306 | 8917 | 8916 | 8915 | 9709 | 6839 | 2167 | 8914 |
| | 9722 | 6835 | 9813 | 9708 | 2159 | 9802 | 9707 | 8918 | 9723 | 6840 | 6834 |
| | 9706 | 8913 | 9814 | 9724 | 1457 | 1458 | 9705 | 2168 | 2158 | 1456 | 6833 |
| | 7307 | 8919 | 6841 | 8092 | 543 | 9801 | 542 | 7302 | 7818 | 9725 | 541 |
| | 8091 | 1459 | 9815 | 7817 | 551 | 9734 | 9733 | 9698 | 550 | 7819 | 9697 |
| | 9732 | 9699 | 540 | 7816 | 9735 | 9975 | 1455 | 9700 | 6832 | 7820 | 9974 |
| | 1460 | 9731 | 9701 | 1372 | 552 | 9696 | 9726 | 9736 | 7815 | 1373 | 6842 |
| | 1454 | 7821 | 7238 | 8912 | 8093 | 1371 | 9816 | 9695 | 9730 | 3886 | 9737 |
| | 3887 | 7814 | 1447 | 3885 | 3889 | 3888 | 3890 | 3891 | 3892 | 539 | 9800 |
| | 5092 | 3893 | 7237 | 9727 | 9973 | 9694 | 8090 | 8920 | 7822 | 9278 | 3884 |
| | 2169 | 9738 | 553 | 9279 | 9729 | 2157 | 9277 | 9280 | 3894 | 7899 | 7898 |
| | 9728 | 5093 | 7897 | 7895 | 7896 | 9693 | 7893 | 7892 | 1374 | 7891 | 1362 |
| | 1441 | 1442 | 1446 | 1461 | 9739 | 1440 | 9276 | 7890 | 9692 | 7239 | 9740 |
| | 1361 | 701 | 5094 | 3883 | 1439 | 9281 | 403 | 7301 | 392 | 393 | 394 |
| | 402 | 404 | 7639 | 405 | 9817 | 1443 | 391 | 1370 | 7236 | 7638 | 1363 |
| | 9972 | 7308 | 1445 | 9691 | 7694 | 7637 | 7889 | 9275 | 8094 | 3895 | 538 |
| | 7695 | 7636 | 700 | 1472 | 2179 | 2181 | 2180 | 7635 | 2182 | 1473 | 7634 | have evolutionary selection for strong folding. In all of them the folding free energy is between −15 and −9.

Locations:

| | | | | | | | | | | | |
|---|---|---|---|---|---|---|---|---|---|---|---|
| 554 | 390 | 5095 | 2178 | 406 | 7633 | 7631 | 7632 | 1444 | 7630 | 8089 | 1464 |
| | 1360 | 9818 | 3882 | 1375 | 7240 | 6823 | 1438 | 1465 | 8921 | 3268 | 2183 |
| | 1474 | 5161 | 699 | 5160 | 7696 | 2265 | 8911 | 5162 | 7629 | 1466 | 9690 |
| | 9274 | 9971 | 3357 | 1364 | 3267 | 2177 | 407 | 1467 | 5159 | 5096 | 9819 |
| | 7888 | 7235 | 2184 | 1674 | 1675 | 1676 | 389 | 3581 | 1677 | 1437 | 1588 |
| | 4037 | 4036 | 1589 | 1673 | 3580 | 3582 | 3358 | 6822 | 1436 | 4458 | 1435 |
| | 2641 | 3579 | 7697 | 449 | 1475 | 1434 | 3578 | 305 | 1369 | 2642 | 3577 |
| | 4035 | 4459 | 5163 | 537 | 7628 | 3896 | 4457 | 3266 | 3881 | 304 | 1468 |
| | 1587 | 2176 | 1672 | 1590 | 2266 | 3576 | 3583 | 4038 | 7309 | 3359 | 1359 |
| | 2640 | 7241 | 9820 | 8095 | 3360 | 1469 | 5198 | 555 | 2616 | 4449 | 698 |
| | 1591 | 4039 | 2185 | 1671 | 1181 | 4034 | 1182 | 9821 | 5199 | 4450 | 306 |
| | 3265 | 4460 | 5197 | 448 | 5158 | 4456 | 3361 | 9689 | 1180 | 9822 | 1678 |
| | 9273 | 1365 | 2175 | 408 | 8088 | 7627 | 1476 | 9911 | 8134 | 2615 | 4448 |
| | 4451 | 9910 | 3264 | 3575 | 303 | 3353 | 2617 | 7355 | 8135 | 1670 | 9909 |
| | 8133 | 2643 | 388 | 5164 | 2267 | 3584 | 8136 | 7698 | 9791 | 7398 | 7399 |
| | 9908 | 1047 | 8922 | 3880 | 6821 | 1183 | 7234 | 5200 | 4033 | 9912 | 1048 |
| | 5951 | 5952 | 1586 | 7887 | 1432 | 7354 | 8137 | 2186 | 8132 | 2639 | 9823 |
| | 6092 | 1049 | 6091 | 7400 | 1669 | 9988 | 9987 | 4461 | 4125 | 9998 | 3263 |
| | 9986 | 1179 | 2618 | 6090 | 1679 | 5196 | 1050 | 6089 | 6961 | 3574 | 1358 |
| | 2174 | 6962 | 1043 | 119 | 7356 | 7397 | 9790 | 3362 | 5165 | 4126 | 307 |
| | 5950 | 9907 | 3585 | 1042 | 3897 | 2268 | 4447 | 2365 | 409 | 7353 | 1051 | have evolutionary selection for strong folding. In all of them the folding free energy is between −9 and −8.

Locations:

| | | | | | | | | | | | |
|---|---|---|---|---|---|---|---|---|---|---|---|
| 3879 | 1041 | 1668 | 697 | 1978 | 536 | 2249 | 4032 | 7626 | 5953 | 7401 | 9989 |
| | 6963 | 9913 | 7242 | 1528 | 5157 | 1184 | 1052 | 1585 | 1529 | 2366 | 2248 |
| | 1530 | 4127 | 2644 | 8247 | 1667 | 1386 | 8910 | 5949 | 8131 | 8246 | 447 |
| | 2250 | 1040 | 9824 | 4201 | 6093 | 1053 | 9688 | 2619 | 9906 | 423 | 9997 |
| | 387 | 302 | 8245 | 2187 | 1977 | 4200 | 9914 | 3352 | 6964 | 3573 | 2638 |
| | 1054 | 1431 | 2367 | 4128 | 3419 | 424 | 1666 | 4202 | 1680 | 426 | 4130 |
| | 9789 | 5195 | 4129 | 9915 | 1039 | 425 | 556 | 9990 | 9905 | 9996 | 1357 |
| | 7352 | 5166 | 5579 | 5580 | 4203 | 6820 | 9916 | 268 | 1976 | 3420 | 2629 |
| | 3586 | 3484 | 1531 | 7233 | 1356 | 2630 | 5954 | 5578 | 4692 | 6965 | 2247 |
| | 267 | 9825 | 3485 | 2269 | 5581 | 4462 | 9917 | 2628 | 1355 | 1038 | 308 |

-continued

| | | | | | | | | | | | |
|---|---|---|---|---|---|---|---|---|---|---|---|
| | 3483 | 7357 | 8244 | 8130 | 1354 | 4693 | 7886 | 9995 | 2620 | 2631 | 1527 |
| | 495 | 1353 | 2368 | 8248 | 3486 | 2364 | 9918 | 427 | 3482 | 2627 | 6246 |
| | 5577 | 494 | 1665 | 3572 | 4691 | 7396 | 1975 | 3481 | 410 | 120 | 2626 |
| | 9991 | 8715 | 266 | 5582 | 9919 | 3487 | 4204 | 6094 | 1681 | 496 | 9904 |
| | 1387 | 4694 | 9994 | 9992 | 9920 | 9788 | 7625 | 2625 | 1037 | 3587 | 5576 |
| | 5156 | 428 | 3351 | 696 | 301 | 2246 | 7358 | 1430 | 5194 | 8129 | 9993 |
| | 7405 | 3488 | 6247 | 1532 | 4463 | 535 | 2624 | 4690 | 309 | 9921 | 2621 |
| | 1974 | 9687 | 411 | 493 | 5356 | 2623 | 8716 | 429 | 1526 | 5358 | 1664 |
| | 5357 | 8714 | 2622 | 6245 | 6344 | 6112 | 6113 | 1682 | 6111 | 5583 | 7359 |
| | 446 | 820 | 557 | 6114 | 6743 | 1683 | 281 | 6110 | 3489 | 2363 | 8249 |
| | 4464 | 5955 | 6742 | 821 | 430 | 5359 | 822 | 823 | 3345 | 1684 | 2369 | have evolutionary selection for strong folding. In all of them the folding free energy is between −7 and −6.
Locations:

| | | | | | | | | | | | |
|---|---|---|---|---|---|---|---|---|---|---|---|
| 9781 | 9903 | 8360 | 1388 | 6819 | 824 | 5965 | 2245 | 3346 | 6095 | 3350 | 277 |
| | 497 | 280 | 6724 | 4205 | 6115 | 278 | 1429 | 6744 | 1036 | 7395 | 3347 |
| | 534 | 9787 | 8361 | 6248 | 9613 | 7624 | 279 | 276 | 6741 | 4689 | 8713 |
| | 3344 | 1522 | 8909 | 1663 | 3348 | 533 | 272 | 300 | 3349 | 2003 | 2004 |
| | 6343 | 1973 | 2005 | 2006 | 275 | 6725 | 8717 | 4875 | 4465 | 8362 | 121 |
| | 2002 | 8250 | 2761 | 492 | 825 | 4876 | 273 | 6244 | 1428 | 532 | 2362 |
| | 5155 | 3490 | 9612 | 2007 | 531 | 5360 | 274 | 6726 | 3343 | 5964 | 695 |
| | 3849 | 7386 | 558 | 565 | 7387 | 1691 | 2760 | 9782 | 7385 | 2244 | 8363 |
| | 5956 | 1095 | 564 | 9902 | 1692 | 6727 | 9484 | 6740 | 1389 | 9485 | 2991 |
| | 8251 | 2992 | 9786 | 566 | 1098 | 563 | 6730 | 8364 | 1662 | 6729 | 9611 |
| | 4688 | 4206 | 6096 | 5963 | 7623 | 2008 | 6728 | 3342 | 1521 | 3848 | 4466 |
| | 1693 | 1225 | 498 | 559 | 8712 | 445 | 7394 | 2759 | 2993 | 2361 | 6818 |
| | 1536 | 1972 | 562 | 8718 | 6249 | 5957 | 5962 | 6342 | 3491 | 5958 | 8252 |
| | 5361 | 4415 | 9783 | 2846 | 8255 | 560 | 567 | 6731 | 5961 | 8253 | 1035 |
| | 8254 | 1226 | 9483 | 3847 | 8256 | 561 | 2845 | 8908 | 3341 | 9785 | 2843 |
| | 2844 | 2936 | 826 | 4467 | 1694 | 8723 | 1390 | 2994 | 9784 | 4687 | 8257 |
| | 2848 | 2842 | 9610 | 491 | 9901 | 2758 | 8724 | 1227 | 1405 | 2360 | 7152 |
| | 3340 | 4414 | 2849 | 6243 | 6732 | 8722 | 4468 | 8725 | 2757 | 8719 | 8263 |
| | 3338 | 8258 | 3339 | 3845 | 3492 | 8264 | 568 | 8711 | 499 | 2850 | 7153 |
| | 1228 | 2841 | 6097 | 5154 | 4469 | 1971 | 4686 | 2756 | 1964 | 2935 | 3337 |
| | 9482 | 6739 | 8265 | 4470 | 1406 | 8259 | 3794 | 1695 | 2753 | 2851 | 8721 | have evolutionary selection for strong folding. In all of them the folding free energy is between −6 and −5.
Locations:

| | | | | | | | | | | | |
|---|---|---|---|---|---|---|---|---|---|---|---|
| 2754 | 6341 | 2840 | 4471 | 4207 | 3493 | 2755 | 4413 | 6250 | 2852 | 2752 | 2853 |
| | 8266 | 4487 | 4472 | 6098 | 1537 | 3500 | 2854 | 3499 | 3498 | 8262 | 8260 |
| | 7154 | 827 | 3336 | 8720 | 500 | 3497 | 2839 | 3501 | 569 | 1965 | 4350 |
| | 2855 | 1034 | 9481 | 3496 | 2751 | 3495 | 4473 | 1407 | 3494 | 4486 | 1970 |
| | 490 | 9609 | 1966 | 3335 | 2856 | 2750 | 2715 | 8267 | 6099 | 2934 | 5153 |
| | 6340 | 1967 | 503 | 504 | 4485 | 2714 | 4412 | 501 | 1408 | 6242 | 7155 |
| | 4351 | 570 | 2027 | 502 | 2028 | 2711 | 2029 | 2710 | 2709 | 2026 | 2706 |
| | 2857 | 2713 | 3793 | 2708 | 3334 | 4474 | 2705 | 1968 | 2712 | 2702 | 489 |
| | 2707 | 828 | 2704 | 4208 | 1010 | 2749 | 2030 | 1969 | 1409 | 6100 | 2703 |
| | 4352 | 1538 | 2933 | 2701 | 2690 | 7156 | 2858 | 488 | 571 | 4353 | 3333 |
| | 2691 | 4484 | 2700 | 9608 | 2031 | 2748 | 2689 | 6101 | 5152 | 2747 | 2932 |
| | 2699 | 4411 | 4475 | 4354 | 2567 | 2568 | 2698 | 4355 | 2692 | 1011 | 2569 |
| | 2733 | 7157 | 4356 | 2566 | 2570 | 2859 | 2032 | 2693 | 2571 | 2572 | 6102 |
| | 2734 | 4483 | 2565 | 2742 | 1012 | 2573 | 4209 | 2738 | 2737 | 2697 | 2741 |
| | 2564 | 4357 | 2740 | 2694 | 2345 | 2536 | 7158 | 2574 | 2348 | 2739 | 5151 |
| | 2736 | 2563 | 4410 | 4476 | 1013 | 2349 | 2735 | 2347 | 1539 | 1287 | 2696 |
| | 2575 | 9607 | 4482 | 7213 | 2695 | 2346 | 2523 | 2033 | 2576 | 7212 | 1014 |
| | 2535 | 4358 | 4210 | 4477 | 1021 | 4481 | 1015 | 2524 | 7211 | 2577 | 2534 |
| | 1288 | 4478 | 1016 | 2525 | 4480 | 4479 | 2034 | 9606 | 2533 | 1020 | 2578 |
| | 7210 | 2526 | 2532 | 1017 | 2579 | 3977 | 2531 | 3975 | 3976 | 3978 | 1019 |
| | 2530 | 2529 | 2528 | 2527 | 2580 | 1018 | 7209 | 3979 | 7208 | 7207 | | have evolutionary selection for strong folding. In all of them the folding free energy is between −5 and −0.5.

Locations:

| | | | | | | | | | | | |
|---|---|---|---|---|---|---|---|---|---|---|---|
| 554 | 555 | 8434 | 5349 | 4054 | 6354 | 4055 | 7347 | 4053 | 5350 | 8433 | 5348 |
| | 4056 | 536 | 4061 | 6942 | 4062 | 5351 | 4063 | 6538 | 4064 | 4060 | 4052 |
| | 4065 | 6943 | 4059 | 8432 | 9184 | 4057 | 4058 | 6353 | 6941 | 556 | 8431 |
| | 6949 | 6950 | 6944 | 109 | 6948 | 7348 | 5352 | 6352 | 6947 | 2247 | 6946 |
| | 3262 | 6945 | 6951 | 4051 | 6351 | 6940 | 5347 | 6350 | 2889 | 6952 | 6539 |
| | 6953 | 10043 | 10044 | 8430 | 334 | 6954 | 5042 | 4050 | 10042 | 2246 | |
| | 10041 | 535 | 333 | 335 | 7349 | 10040 | 10045 | 9416 | 4049 | 446 | |
| | 10046 | 557 | 6939 | 8429 | 3261 | 8424 | 332 | 1102 | 2888 | 5315 | 6546 |
| | 5041 | 7350 | 2245 | 6545 | 8234 | 8425 | 1101 | 8428 | 534 | 8595 | 108 |
| | 6547 | 6540 | 5504 | 336 | 6544 | 8427 | 533 | 8426 | 9417 | 5314 | 3006 |
| | 530 | 9649 | 5505 | 9183 | 9650 | 8235 | 3007 | 9648 | 5781 | 1100 | 6686 |
| | 7266 | 3005 | 6938 | 532 | 9651 | 531 | 8236 | 3850 | 3849 | 2887 | 558 |
| | 5639 | 5506 | 6548 | 2244 | 3851 | 9454 | 564 | 9484 | 9485 | 8485 | 9647 |
| | 96 | 6500 | 9634 | 867 | 5635 | 3569 | 5040 | 6543 | 4514 | 1098 | 4515 |
| | 563 | 1099 | 9486 | 8237 | 4513 | 3852 | 8935 | 3063 | 3848 | 5507 | 3004 |
| | 559 | 5638 | 5313 | 6776 | 5636 | 6541 | 445 | 8230 | 4516 | 9455 | 3009 |
| | 868 | 5637 | 6557 | 7260 | 2243 | 562 | 3260 | 2242 | 6777 | 6937 | 9652 |
| | 3564 | 107 | 337 | 2886 | 6936 | 4512 | 2241 | 4517 | 7800 | 9864 | 6775 |
| | 3860 | 7125 | 2240 | 9646 | 560 | 7801 | 3394 | 9418 | 6556 | 9483 | 3847 |
| | 7430 | 6549 | 561 | 869 | 5782 | 2239 | 4518 | 3568 | 627 | 6542 | 7429 |
| | 5508 | 7431 | 1263 | 6935 | 7267 | 7063 | 5336 | 7928 | | | | have evolutionary selection for weak folding. In all of them the folding free energy is between −9 and −5.
Locations

| | | | | | | | | | | | |
|---|---|---|---|---|---|---|---|---|---|---|---|
| 1264 | 6550 | 9456 | 6555 | 6491 | 3393 | 6499 | 8940 | 9635 | 7802 | 97 | 2238 |
| | 6492 | 7428 | 642 | 6778 | 3003 | 9645 | 6490 | 7432 | 2885 | 4519 | 6551 |
| | 441 | 7427 | 4511 | 3859 | 3846 | 5509 | 4768 | 7152 | 5337 | 7929 | 2232 |
| | 6554 | 7124 | 1265 | 3854 | 5312 | 3010 | 6774 | 9642 | 6552 | 3062 | 6553 |
| | 8486 | 7806 | 444 | 9637 | 9638 | 4767 | 7803 | 3845 | 6489 | 9636 | 7151 |
| | 3855 | 3858 | 3844 | 2237 | 7123 | 9644 | 5510 | 8520 | 7153 | 9653 | 3567 |
| | 6934 | 7930 | 8936 | 6493 | 2233 | 1796 | 3565 | 3392 | 9643 | 8770 | 7150 |
| | 7062 | 6488 | 4520 | 3856 | 5887 | 9482 | 7804 | 871 | 106 | 2234 | 3857 |
| | 4766 | 4510 | 442 | 9459 | 8939 | 9419 | 5467 | 8521 | 1266 | 2236 | 2127 |
| | 6487 | 5039 | 7122 | 7119 | 7931 | 443 | 4471 | 5888 | 8229 | 2235 | 4207 |
| | 7961 | 338 | 5511 | 7149 | 8526 | 6498 | 7120 | 98 | 6765 | 3002 | 7121 |
| | 3566 | 7805 | 9460 | 5311 | 872 | 8525 | 4472 | 7118 | 4509 | 5783 | 6494 |
| | 7117 | 3391 | 7010 | 6766 | 5889 | 4521 | 7154 | 7673 | 3011 | 6764 | 9461 |
| | 7268 | 3378 | 2998 | 7061 | 8522 | 8527 | 9182 | 4582 | 9462 | 9463 | 9464 |
| | 9465 | 9481 | 5468 | 6779 | 7932 | 6685 | 873 | 2126 | 8937 | 1519 | 1267 |
| | 349 | 8938 | 1617 | 5512 | 1924 | 3390 | 348 | 4508 | 9420 | 6773 | 5890 |
| | 9668 | 4473 | 7148 | 5248 | 9654 | 7116 | 7259 | 9667 | 9863 | 4765 | 9666 |
| | 4587 | 1618 | 9466 | 8524 | 3001 | 5469 | 8785 | 5310 | 4499 | 2999 | 8487 |
| | 7674 | 3259 | 628 | 4247 | 8523 | 6767 | 9665 | 9664 | 7975 | 99 | 4507 |
| | 9362 | 3389 | 5891 | 7933 | 1619 | 5470 | 641 | 4246 | 7105 | 5519 | 5892 |
| | 1881 | 4506 | 1880 | 7962 | 7974 | 6497 | | | | | | have evolutionary selection for weak folding. In all of them the folding free energy is between −5 and −4.
Locations:

| | | | | | | | | | | | |
|---|---|---|---|---|---|---|---|---|---|---|---|
| 1879 | 5893 | 350 | 4522 | 9663 | 7060 | 1620 | 9421 | 5308 | 4248 | 8786 | 4586 |
| | 6495 | 4585 | 6772 | 7147 | 1622 | 3000 | 9489 | 5518 | 5894 | 1795 | 5309 |
| | 9480 | 3379 | 8792 | 4505 | 1621 | 8769 | 5520 | 5513 | 2125 | 5895 | 9467 |
| | 1882 | 7973 | 6780 | 4583 | 6771 | 4500 | 4584 | 5896 | 3388 | 4249 | 6770 |
| | 7968 | 6768 | 7972 | 6769 | 339 | 6496 | 104 | 7969 | 5521 | 7675 | 5522 |
| | 7146 | 5517 | 1883 | 8787 | 3258 | 7970 | 3012 | 1623 | 4504 | 7967 | 7971 |
| | 630 | 7059 | 4250 | 5516 | 9599 | 7269 | 5897 | 100 | 8791 | 4764 | 7011 |
| | 5471 | 9655 | 629 | 7056 | 7057 | 7058 | 4245 | 4474 | 7115 | 5038 | 6199 |
| | 1884 | 7104 | 4523 | 103 | 4501 | 3387 | 5514 | 3017 | 351 | 7966 | 4208 |
| | 7963 | 347 | 8228 | 101 | 9479 | 4251 | 7934 | 7055 | 102 | 9662 | 4502 |
| | 8788 | 5515 | 1885 | 4503 | 6781 | 6198 | 8790 | 9509 | 5249 | 9850 | 2025 |
| | 1624 | 7965 | 8789 | 5853 | 2124 | 7145 | 9490 | 7054 | 9852 | 4524 | 3016 |
| | 7680 | 9851 | 5898 | 7964 | 7746 | 6197 | 7096 | 2374 | 6782 | 7270 | 3386 |
| | 9468 | 7114 | 9508 | 7258 | 1923 | 5854 | 9064 | 9065 | 3380 | 9067 | 9066 |
| | 352 | 4525 | 1517 | 4244 | 7676 | 631 | 595 | 2024 | 9068 | 7255 | 9063 |
| | 1625 | 1516 | 9862 | 6911 | 3015 | 9507 | 5784 | 9069 | 9070 | 9661 | 9853 |
| | 6910 | 9478 | 3013 | 6912 | 9506 | 6930 | 4475 | 640 | 9062 | 7679 | 8768 |
| | 3014 | 7935 | 8488 | 9071 | 5855 | 9656 | 9181 | 340 | 9600 | 6913 | 3385 |
| | 7012 | 3282 | 7053 | 9061 | 9854 | 633 | 632 | 1333 | 7113 | 6196 | 3381 |
| | 5899 | 7678 | 9171 | 6919 | 9263 | 7018 | 1794 | 5037 | 9072 | 6914 | 9491 |
| | 2023 | 589 | 194 | 6918 | 6915 | 1711 | | | | | | have evolutionary selection for weak folding. In all of them the folding free energy is between −4 and −3.
Locations:

| 346 | 6920 | 5250 | 1712 | 7019 | 2123 | 7017 | 1626 | 6916 | 1715 | 3384 | 1713 |
|---|---|---|---|---|---|---|---|---|---|---|---|
| | 1714 | 6665 | 3382 | 8762 | 1334 | 6917 | 3383 | 9073 | 1716 | 590 | 7677 |
| | 6929 | 9660 | 9657 | 7097 | 7020 | 9469 | 6783 | 9855 | 7257 | 6921 | 1710 |
| | 7256 | 4209 | 7103 | 9477 | 201 | 2375 | 2388 | 1335 | 7747 | 5856 | 1708 |
| | 7021 | 1337 | 7112 | 9659 | 594 | 1705 | 7016 | 574 | 786 | 1707 | 1709 |
| | 2022 | 9172 | 1336 | 9658 | 7936 | 4476 | 7013 | 4644 | 584 | 7022 | 9492 |
| | 583 | 6922 | 9861 | 341 | 1147 | 2219 | 1706 | 10136 | 10135 | 7111 | 1627 |
| | 6928 | 193 | 10134 | 593 | 1728 | 4643 | 10133 | 6143 | 9856 | 6142 | 4213 |
| | 10137 | 7023 | 10132 | 9262 | 5900 | 6141 | 591 | 4642 | 7052 | 8226 | 634 |
| | 6140 | 10139 | 6144 | 7015 | 9601 | 8767 | 1922 | 9476 | 10131 | 6195 | 7024 |
| | 2033 | 1628 | 588 | 1123 | 4641 | 10138 | 10130 | 8494 | 2387 | 7025 | 592 |
| | 8763 | 1729 | 9493 | 2021 | 575 | 4362 | 785 | 1629 | 7026 | 6923 | |
| | 10140 | 7027 | 5251 | 585 | 6139 | 7028 | 9180 | 9470 | 202 | 7029 | 1146 |
| | 586 | 186 | 7098 | 345 | 4358 | 6784 | 9173 | 6927 | 4210 | 587 | 1730 |
| | 5857 | 3283 | 7014 | 3722 | 6138 | 4640 | 9860 | 582 | 639 | 2020 | 342 |
| | 9859 | 9858 | 4212 | 3721 | 5785 | 9857 | 9475 | 1511 | 10141 | 8489 | 192 |
| | 187 | 8764 | 784 | 6924 | 2225 | 4361 | 4635 | 2376 | 4359 | 1731 | 8766 |
| | 4638 | 7748 | 1145 | 3720 | 576 | 2220 | 2386 | 4360 | 6926 | 4639 | 8765 |
| | 8225 | 10142 | 5901 | 188 | 9261 | 7030 | 2042 | 2221 | 372 | 3719 | 203 |
| | 10143 | 6925 | 4637 | 6664 | 1793 | 9179 | 1733 | 2041 | 1732 | 9474 | 191 |
| | 344 | 9471 | 2224 | 1734 | 3718 | 9174 | 7102 | | | | | have evolutionary selection for weak folding. In all of them the folding free energy is between −3 and −2.
Locations

| 1510 | 4636 | 8046 | 8045 | 4211 | 5252 | 343 | 190 | 189 | 2222 | 8490 | 7051 |
|---|---|---|---|---|---|---|---|---|---|---|---|
| | 1735 | 2034 | 5858 | 9602 | 9606 | 783 | 2377 | 2223 | 8047 | 638 | 9473 |
| | 1144 | 8493 | 637 | 636 | 2040 | 6785 | 7099 | 635 | 8044 | 8039 | 8038 |
| | 1736 | 9178 | 9472 | 782 | 5786 | 8037 | 8040 | 2385 | 8491 | 5255 | 577 |
| | 581 | 9177 | 5253 | 10144 | 1124 | 1143 | 5902 | 1142 | 8043 | 8041 | 7031 |
| | 3284 | 368 | 1737 | 2378 | 5254 | 781 | 8042 | 8492 | 7749 | 8224 | 2379 |
| | 5905 | 2039 | 9260 | 3717 | 9176 | 2380 | 1921 | 2381 | 1141 | 9255 | 8048 |
| | 2382 | 9175 | 1738 | 9256 | 2383 | 2384 | 1509 | 8294 | 5787 | 9257 | 2821 |
| | 9254 | 5903 | 2035 | 5904 | 9258 | 5859 | 9259 | 9253 | 5788 | 8295 | 7101 |
| | 2038 | 7750 | 371 | 9605 | 6786 | 7032 | 369 | 7050 | 9252 | 9603 | 578 |
| | 9243 | 2820 | 9251 | 1140 | 8223 | 9604 | 8296 | 7100 | 2817 | 1508 | 9242 |
| | 7751 | 2036 | 9250 | 580 | 1125 | 9244 | 1775 | 1776 | 8297 | 1792 | 1777 |
| | 8049 | 2819 | 2818 | 9241 | 1774 | 2037 | 8298 | 9249 | 8299 | 6663 | 9240 |
| | 9245 | 1507 | 8300 | 5860 | 1506 | 9232 | 9233 | 9234 | 9231 | 9248 | 8301 |
| | 9235 | 9247 | 9239 | 9236 | 9230 | 7033 | 1139 | 1773 | 9246 | 1126 | 8302 |
| | 9229 | 9237 | 5861 | 579 | 1920 | 8222 | 9238 | 7049 | 1791 | 1127 | 1906 |
| | 1905 | 1907 | 1908 | 1772 | 1909 | 1128 | 1910 | 8050 | 1129 | 1911 | 1912 |
| | 1913 | 1130 | 1138 | 1918 | 1919 | 1917 | 1914 | 1916 | 1915 | 1771 | 1790 |
| | 7048 | 7034 | 1131 | 7047 | 1770 | 7035 | 1132 | 6662 | 7046 | 1137 | 7036 |
| | 7045 | 1769 | 1133 | 7044 | 7043 | 7037 | 7042 | 7041 | 1134 | 7040 | 1136 |
| | 7039 | 7038 | 6661 | 1135 | | | | | | | | have evolutionary selection for weak folding. In all of them the folding free energy is between −2 and −0.2.

According to a particular embodiment, the folding energy refers to a local folding energy (e.g. in genomic windows of between 20-100 nucleotides, 30-90 nucleotides, 30-80 nucleotides, 30-70 nucleotides, 30-60 nucleotides, 30-50 nucleotides, 30-40 nucleotides).

The genetic modifications (e.g. synonymous codon substitutions) may be engineered in locations undergoing conserved evolutionary selection for strong or weak folding distributed throughout the genome, or in multiple locations restricted to a portion of the genome e.g. in a region which encodes one, two, three, four or more particular proteins. In one embodiment, the genetic modifications (synonymous codon substitutions) are effected throughout an RNA (or DNA transcribable to same) which encodes a polypeptide.

In one embodiment, the modifications are effected over a length of at least about 500 nucleotides, 1000 nucleotides, 5000 nucleotides or more.

In further embodiments, the portion of the genome encoding the capsid coding region is modified so as to alter the evolutionarily conserved structure of the RNA.

Preferably, the modifications (e.g. synonymous codon substitutions) are effected such that at least 3, 5, 10, 15, 20, 25, 30, 35, 40, 45, 50, 100, 150, 200, 250, 300, 350, 400, 450, 500 local sites of evolutionarily conserved structure are altered, for example 3-500, 10-50, 20-400, 20-300, 20-200.

In another embodiment, the modifications (e.g. synonymous codon substitutions) are effected such that at least 0.1% 0.5%, 1%, 2%, 3%, 4%, 5%, 6%, 7%, 8%, 9%, 10% of the viral genome is altered.

According to another embodiment, the modifications (e.g. synonymous codon substitutions) are effected such that the increase in folding energy at at least one location of evolutionarily conserved structure (i.e. undergoing an evolutionary selection for strong folding) is greater than 9 kcal/mol, more preferably greater than 9.5 kcal/mol, and even more preferably greater than 10 kcal/mol, and best preferably about 12 kcal/mol.

According to another embodiment, the modifications (e.g. synonymous codon substitutions) are effected such that the decrease in folding energy at at least one location of evolutionarily conserved non-structure (i.e. undergoing an evolutionary selection for weak folding) is greater than 20 kcal/mol, more preferably greater than 22 kcal/mol, and even more preferably greater than 25 kcal/mol, and best preferably 25 kcal/mol.

According to another embodiment, the modifications (e.g. synonymous codon substitutions) are effected such that the increase in folding energy at least 20% of the locations of evolutionarily conserved structure (i.e. undergoing an evolutionary selection for strong folding) is greater than 7 kcal/mol, more preferably greater than 8 kcal/mol, and even more preferably greater than 10 kcal/mol, and best preferably about 12 kcal/mol.

According to another embodiment, the modifications (e.g. synonymous codon substitutions) are effected such that the decrease in folding energy at at least 20% of the locations of evolutionarily conserved non-structure (i.e. undergoing an evolutionary selection for weak folding) is greater than 17 kcal/mol, more preferably greater than 19 kcal/mol, and even more preferably greater than 21 kcal/mol, and best preferably 23 kcal/mol.

According to another embodiment, the modifications (e.g. synonymous codon substitutions) are effected such that the increase in folding energy at at least 30% of the locations of evolutionarily conserved structure (i.e. undergoing an evolutionary selection for strong folding) is greater than 6 kcal/mol, more preferably greater than 8 kcal/mol, and even more preferably greater than 9 kcal/mol, and best preferably 11 kcal/mol.

According to another embodiment, the modifications (e.g. synonymous codon substitutions) are effected such that the decrease in folding energy at at least 30% of the locations of evolutionarily conserved non-structure (i.e. undergoing an evolutionary selection for weak folding) is greater than 16 kcal/mol, more preferably greater than 18 kcal/mol, and even more preferably greater than 20 kcal/mol, and best preferably 22 kcal/mol.

According to another embodiment, the modifications (e.g. synonymous codon substitutions) are effected such that the increase in folding energy at at least 40% of the locations of evolutionarily conserved structure (i.e. undergoing an evolutionary selection for strong folding) is greater than 6 kcal/mol, more preferably greater than 8 kcal/mol, and even more preferably greater than 9 kcal/mol, and best preferably 10 kcal/mol.

According to another embodiment, the modifications (e.g. synonymous codon substitutions) are effected such that the decrease in folding energy at at least 40% of the locations of evolutionarily conserved non-structure (i.e. undergoing an evolutionary selection for weak folding) is greater than 15 kcal/mol, more preferably greater than 17 kcal/mol, and even more preferably greater than 20 kcal/mol, and best preferably 22 kcal/mol.

According to another embodiment, the modifications (e.g. synonymous codon substitutions) are effected such that the increase in folding energy at at least 50% of the locations of evolutionarily conserved structure (i.e. undergoing an evolutionary selection for strong folding) is greater than 6 kcal/mol, more preferably greater than 7 kcal/mol, and even more preferably greater than 9 kcal/mol, and best preferably 10 kcal/mol.

According to another embodiment, the modifications (e.g. synonymous codon substitutions) are effected such that the decrease in folding energy at at least 50% of the locations of evolutionarily conserved non-structure (i.e. undergoing an evolutionary selection for weak folding) is greater than 14 kcal/mol, more preferably greater than 17 kcal/mol, and even more preferably greater than 19 kcal/mol, and best preferably 22 kcal/mol.

According to another embodiment, the modifications (e.g. synonymous codon substitutions) are effected such that the increase in folding energy at at least 60% of the locations of evolutionarily conserved structure (i.e. undergoing an evolutionary selection for strong folding) is greater than 5 kcal/mol, more preferably greater than 7 kcal/mol, and even more preferably greater than 8 kcal/mol, and best preferably 10 kcal/mol.

According to another embodiment, the modifications (e.g. synonymous codon substitutions) are effected such that the decrease in folding energy at at least 60% of the locations of evolutionarily conserved non-structure (i.e. undergoing an evolutionary selection for weak folding) is greater than 14 kcal/mol, more preferably greater than 16, and even more preferably greater than 19 kcal/mol, and best preferably 21 kcal/mol.

According to another embodiment, the modifications (e.g. synonymous codon substitutions) are effected such that the increase in folding energy at at least 70% of the locations of evolutionarily conserved structure (i.e. undergoing an evolutionary selection for strong folding) is greater than 5 kcal/mol, more preferably greater than 6 kcal/mol, and even more preferably greater than 8 kcal/mol, and best preferably 10 kcal/mol.

According to another embodiment, the modifications (e.g. synonymous codon substitutions) are effected such that the decrease in folding energy at at least 70% of the locations of evolutionarily conserved non-structure (i.e. undergoing an evolutionary selection for weak folding) is greater than 13 kcal/mol, more preferably greater than 16 kcal/mol, and even more preferably greater than 18 kcal/mol, and best preferably 21 kcal/mol.

According to another embodiment, the modifications (e.g. synonymous codon substitutions) are effected such that the increase in folding energy at at least 80% of the locations of evolutionarily conserved structure (i.e. undergoing an evolutionary selection for strong folding) is greater than 4 kcal/mol, more preferably greater than 6 kcal/mol, and even more preferably greater than 8 kcal/mol, and best preferably 10 kcal/mol.

According to another embodiment, the modifications (e.g. synonymous codon substitutions) are effected such that the decrease in folding energy at at least 80% of the is locations of evolutionarily conserved non-structure (i.e. undergoing an evolutionary selection for weak folding) is greater than 12 kcal/mol, more preferably greater than 15 kcal/mol, and even more preferably greater than 18 kcal/mol, and best preferably 21 kcal/mol.

According to another embodiment, the modifications (e.g. synonymous codon substitutions) are effected such that the increase in folding energy at at least 90% of the locations of evolutionarily conserved structure (i.e. undergoing an evolutionary selection for strong folding) is greater than 4 kcal/mol, more preferably greater than 6 kcal/mol, and even more preferably greater than 8 kcal/mol, and best preferably 10 kcal/mol.

According to another embodiment, the modifications (e.g. synonymous codon substitutions) are effected such that the decrease in folding energy at at least 90% of the locations of evolutionarily conserved non-structure (i.e. undergoing an evolutionary selection for weak folding) is greater than 10 kcal/mol, more preferably greater than 14 kcal/mol, and even more preferably greater than 18 kcal/mol, and best preferably 21 kcal/mol.

According to another embodiment, the modifications (e.g. synonymous codon substitutions) are effected such that the increase in folding energy at least 95% of the locations of evolutionarily conserved structure (i.e. undergoing an evolutionary selection for strong folding) is greater than 3 kcal/mol, more preferably greater than 5 kcal/mol, and even more preferably greater than 8 kcal/mol, and best preferably 10 kcal/mol.

According to another embodiment, the modifications (e.g. synonymous codon substitutions) are effected such that the decrease in folding energy at least 95% of the locations of evolutionarily conserved non-structure (i.e. undergoing an evolutionary selection for weak folding) is greater than 10 kcal/mol, more preferably greater than 14 kcal/mol, and even more preferably greater than 18 kcal/mol, and best preferably 22 to kcal/mol.

According to another embodiment, the modifications (e.g. synonymous codon substitutions) are effected such that the increase in folding energy at 100% of the locations of evolutionarily conserved structure (i.e. undergoing an evolutionary selection for strong folding) is greater than 3 kcal/mol, more preferably greater than 5 kcal/mol, and even more preferably greater than 8 kcal/mol, and best preferably 10 kcal/mol.

According to another embodiment, the modifications (e.g. synonymous codon substitutions) are effected such that the decrease in folding energy at 100% of the locations of evolutionarily conserved non-structure (i.e. undergoing an evolutionary selection for weak folding) is greater than 9 kcal/mol, more preferably greater than 13 kcal/mol, and even more preferably greater than 18 kcal/mol, and best preferably 22 kcal/mol.

In one embodiment, identifying evolutionarily conserved local structure of viral RNA can be carried out as described herein below.

Essentially, nucleic acid sequences of viruses are collected. Such sequences may be available from known databases and/or generated by sequencing viral genomes.

Next, the sequences are aligned. According to a particular embodiment, the viral nucleic acid sequences are computationally translated to the corresponding amino-acid chains which are then mutually aligned. The aligned amino-acid sequences are back translated to the corresponding nucleotide sequences basing on the original nucleotide composition of each genome.

The sequence multiple alignment can be followed by additional procedures, which may potentially improve the robustness and/or the computational efficiency of the subsequent stages of the method. In some embodiments, these procedures may include:

(1) Selection of N most diverse samples from the aligned sequences, when the diversity between two aligned sequences can be measured by the Hamming distance or other appropriate metrics (see Algorithm 1, in the examples section herein below).

(2) Filtration of possibly corrupted sequences, by selecting only those which have up-to K % of positions occupied by indels/ambiguous symbols.

In some embodiments, the numbers N and K are 100 and 5 correspondingly, while in others, they may take any suitable value. Moreover, other embodiments may also include additional preprocessing steps depending on the underlying data and/or any additional constraints.

In the next step, genome randomization is performed. For each sequence, N randomized variants are created. In some embodiments the number N is 20, 50 100 or 200 while in others, or any other suitable value. The randomized variants are restricted to maintain the amino acid sequence, and thus the protein structure, by sampling (with or without repetition) from the set of synonymous codons for each amino acid position. In conjunction, additional constraints may be employed.

In one embodiment two randomization models that consider the codon distribution are used:

HCUB: this randomization/null model maintains the distribution of codons (and the amino acid content) in each genome separately; specifically, each codon in the randomized genome is sampled according to the distribution (frequency) of codons coding the same amino acid in the wild-type genome (see Algorithm 2, in the examples section herein below).

VCUB: this randomization/null model maintains the synonymous codon distribution in each column in the multiple alignment matrix, thus, maintaining the column wise composition of amino acids and the distribution of synonymous codons (and thus nucleotides), but not for each genome separately/horizontally. This is achieved by permuting synonymous codons in each column. In the case of multiple amino acids in a column, each amino acid is permuted separately; thus, obtaining for each amino acid the same codon frequencies as in the original alignment matrix (but in a different order) (see Algorithm 3, in the examples section herein below).

In other words, both random models are based on marginal distributions of synonymous codons encoded in the alignment matrix, but while the HCUB uses the ('horizontal') distributions of synonymous codons defined by the matrix rows, VCUB uses the ('vertical') distributions defined by matrix columns.

In other embodiments randomization models based on additional biologically-motivated constraints may be employed (e.g. constraints on GC content, distribution of dinucleotides).

Construction of Local Genomic Features Profiles:

Local Genomic Features: Local genomic features (LGF) are defined by the compositions of nucleotides that comprise local regions of a genomic sequence. In addition to being responsible for the content of the genetic products directly encoded by the sequence, these compositions may carry additional important regulatory characteristics playing a crucial role in all stages of the viral gene expression. Examples of local genomic features may include among others: measures of nucleotide bias (e.g., distribution of k-mers of nucleotides, GC content); measures of codon usage bias (e.g., distribution of k-mers of codons, transfer RNA and codon adaptation indexes, effective number of codons), sequence regulatory patterns (e.g., order and clustering of codons, Kozak/Shine-Dalgarno-like features, initiation context scores), structural features (e.g., amino-acid charge, folding energy, secondary structure), etc. All these features, are encoded in the genomic sequences (ORFs and UTRs), and may contribute to viral replication regulation and may (at least partially) evolve via synonymous mutations that do not affect the amino acid composition of the encoded protein.

Local Genomic Features Profiles: Profiles of local genomic features are constructed by applying a sliding window of length N with a step S to a genomic sequence. At each step a specific genomic feature of a local genomic region enclosed by the window is calculated, resulting in a LGF profile $$F=[F_1, \ldots, F_i, F_{i+m}, \ldots, F_k],$$

where $F_j$ is the value of a LGF corresponding to the window starting at position j.

In one embodiment, profiles of local folding energies in all 39 nt genomic windows (LGF=folding energy, N=39, S=1) are computed. In other embodiments different values of window size (10-100, 20-90, 30-80, 30-70, 30-60, 30-50) and step, and/or different local genomic features may be used. In some embodiments profiles corresponding to more than one genomic feature may be constructed.

Identification of Single-Sequence Salient Local Regions

A single-sequence evolutionary salient local region is defined to be a local genomic region, corresponding to a position in a profile, in which the corresponding LGF value is statistically significant (based on a comparison to a certain random models). Such regions are possibly under an evolutionary pressure on the corresponding feature (i.e., undergo a positive/negative evolutionary selection). As their name suggests, single-sequence evolutionary salient regions are identified for each sequences separately.

The statistical significance is estimates via a p-value with respect to one or several null model based on randomized genomic variants (see stage 3 above). In general, Monte Carlo methods, based on N randomized variants, provide an empirical p-value estimate, rather than an exact measure, of the real p-value. This empirical approximation has two direct consequences. First, the resolution of the resultant p-values is restricted to 1/N; second, the smallest achievable p-value is 1/N. This means that a very large number of samples is required to accurately estimate a small p-value. In general, more than N samples are required to reliably estimate a p-value of 1/N. Low resolution p-values may limit the applicability of the False Discovery Rate (FDR) correction, which is necessary to prevent large numbers of false positives in a multiple testing framework. On the other hand, the empirical approximation may overestimate p—values that are, in reality, smaller.

These considerations, justify extending the empirical p-value by extrapolating the null model distribution to account for more extreme values.

In one embodiment, to identify single-sequence evolutionary salient local regions a wild-type LGF profile is compared with a matrix of LGF profiles based on randomized variants (each row in the matrix corresponds to one randomized variant). The comparison is performed in a position dependent manner (each position in the wild type profile is compared to the corresponding column in the matrix of randomized profiles) as follows: for each position the one-sample Kolmogorov-Smirnov test (KST) is used to check the null hypothesis whether the sample of random variables given by the corresponding column in the matrix of randomized variants is drawn from a Normal distribution. If the null hypothesis is accepted, the p-value is approximated analytically by the one sided analytical p-value coming from the corresponding Normal distribution with sample mean and sample standard deviation parameters. Otherwise, an empirical p-value is estimated by calculating the portion of the randomized values as extreme as in the wild type (see Algorithm 4, in the examples section herein below).

Positions with empirical p-value<1/N, in which the null hypothesis of KST was not accepted, may be farther, re-estimated using a higher number of randomized variants (leading to a higher resolution empirical p-value).

Local regions corresponding to positions having statistically significant (p-value<1/N) LGF values that pass the False Discovery Rate (FDR) filtering are defined to be single-sequence evolutionary salient local regions.

Identification of Multi Sequence Evolutionary Salient Local Regions:

In some embodiments, it may be required to identify salient genomic regions by analyzing conjointly single-sequence evolutionary salient local regions identified in different sequences.

This analysis is based on a N×L binary Selection Matrix $$S = \begin{bmatrix} \delta_{11} & \cdots & \delta_{1k} \\ \vdots & \ddots & \vdots \\ \delta_{N1} & \cdots & \delta_{Nk} \end{bmatrix}, \delta_{ij} = \begin{cases} 1, & \text{position } j \text{ is salient in profile } i \\ 0, & \text{otherwise} \end{cases}$$

where N is the number of different sequences and L is a corresponding LGF profile length.

The selection matrix is used to construct second-order LGF profiles—profiles that are based on local statistics of single-sequence evolutionary salient local regions identified in different LGF profiles.

The multi-sequence evolutionary salient local regions are defined to be regions corresponding to statistically significant positions in second-order LGF profiles; these regions are mutually salient in all or part of the analyzed sequences.

In one embodiment the multi-sequence salient local regions may be based on the following second-order LGF profiles:

LGF Selection Concentration Profiles

Selection Concentration Profiles are computed by applying a W-nt long sliding window (termed the SCI-interval) on all LGF profiles: in each step the Selection Concentration Index (SCI), defined as the average (over all sequences) number of single-sequence evolutionary salient local regions inside the corresponding window, is calculated (see Algorithm 5, in the examples section herein below). Selection Concentration Profiles characterize the distribution of single-sequence evolutionary salient local regions along the genomes.

In one embodiment the number W is 100, while in others, they may take any suitable value.

SCI-intervals with significantly high selection concentration (significantly high SCI values) are identified by comparing the wild type SCI values in each position to the SCI values from the corresponding positions in the randomized selection concentration profiles generated according to the following algorithm, named One-Versus-Rest (OVR) random model: in each randomized LGF profile, the single-sequence evolutionary salient local regions are identified by comparing it to the rest of the randomized LGF profiles from the same wild-type origin; the obtained salient regions are then used to construct randomized selection concentration profiles (see Algorithm 6, in the examples section herein below), which serve as a baseline (null-model) for an empirical p-value computation (see Algorithm 7, in the examples section herein below). Statistically significant SCI-intervals are named Concentration Intervals (in terms of single-sequence evolutionary salient local regions; see FIGS. 6A-B).

LGF Selection Preservation Profiles

Due to genetic variability on the one hand, and possible inaccuracies in sequencing and multiple alignment on the other, single-sequence evolutionary salient local regions in different genomes may be shifted one with respect to the other. To account for these possible displacements when quantifying the levels of selection preservation, we defined the Selection Preservation Index (SPI) as the percentage of different aligned genomes which have at least one significant position inside a W-nt length genomic interval (termed by us the SPI-interval). In one embodiment, the number W is 25, while in others, they may take any suitable value.

The SPI takes a range of values between 0 and 1: the higher the value—the more different sequences have single-sequence evolutionary salient local regions inside the corresponding SPI-interval (a higher selection preservation), the lower—the less single-sequence evolutionary salient local regions are shared (a lower selection preservation). The Selection Preservation Profiles are calculated by applying a W-nt sliding window to the aligned LGF profiles of all or part of the sequences, and calculating at each step the corresponding SPI value.

SPI-intervals with significantly high selection preservation (significantly high SPI values) are identified by comparing the wild type SPI values in each position to the SPI values from the corresponding positions in the randomized selection preservation profiles generated according to the OVR random model (see the description above and/or Algorithm 7).

In one embodiment SPI-intervals with selection preservation index higher than in 1000 corresponding randomized variants (p-value<0.001; Benjamini-Hochberg FDR=0.001) were chosen; those of them which achieved SPI values higher than maximally achieved SPI in randomized variants were defined as statistically significant SPI-intervals and named Preserved Intervals (in terms of selection preservation in single-sequence salient local regions).

Clusters of Preserved/Concentration Intervals

The resulting Preserved/Concentration are not independent: parts of them belong to intersecting genomic regions and could be possibly attributed to the same or partially-overlapping elements. Therefore, in some embodiments, clusters of concentration intervals/preserved intervals may be computed. A cluster consists of all Preserved/Concentration intervals, such that the distance between the 5' ends of two consecutive intervals in a cluster is no more than D nucleotides.

Selection Concentration and Selection Preservation profiles are considered as second-order LGF profiles; Concentration intervals/Preserved intervals are considered as multi-sequence evolutionary salient local regions.

Sampling of the most significant salient local regions.

In some embodiments, a set of N identified single/multi-sequence evolutionary salient local regions is sub-sampled for K<N most significant regions according to additional rules.

In some embodiments, intersection of regions, mutually salient with respect to some portion of different randomization models, or across different genotypic groups (e.g. serotypes) may be selected.

In other embodiments, single/multi—sequence evolutionary salient local regions identified with respect to each one of the different randomization models (and/or genotypic groups) separately may be ranked individually according to some significance measure (e.g. p-value, z-score); the obtained rank lists are than aggregated and a mutual short list of top K regions is chosen (see Algorithm 8, in the examples section herein below).

The K most significant salient regions may be further sparsified, e.g. by identifying cluster of salient regions and choosing one/several representative of each cluster.

Once the positions of evolutionarily conserved RNA secondary structure are identified, the regions are optimized/deoptimized with respect to the relevant LGF and/or other target functions. Modified sequences (or parts of sequences), based on mutations in one/several salient regions, comprise a potentially live attenuated virus.

In one embodiment the mutations are performed by substituting each codon with its least frequent synonym in the corresponding position in the multiple alignments; i.e. a codon that is not preferred by evolution.

In other embodiments salient regions, selected with respect to a specific LGF may be modified to maximize (minimize) the LGF value: if there is a statistical evidence (based on the randomized model) that in a certain position evolution shape LGF to have a maximal/high value the region may be mutated to decrease the LGF value as much as possible; similarly, if there is a statistical evidence (based on the randomized model) that in a certain position evolution shape LGF to have a minimal/low value the region may be mutated to increase the LGF value as much as possible.

For example, the present invention contemplates maximizing/minimizing local folding energy by changing codon usage while maintaining the encoded protein and possibly other constraints (e.g. the codon usage bias, GC content, etc). Local regions that are inferred to be under evolutionary section to have strong/weak folding according to a randomized model(s) may be manipulated to have weak/strong local folding strength respectively (i.e. the folding strength may be "deoptimized" in the opposite direction). This can be done without affecting the encoded protein(s) or any other feature of the viral genome via a brute force over all possible variants or an optimization algorithm, such as Simulated Annealing (Algorithm 9 and FIG. 7). The resulting sequence with manipulated local regions may be referred to as a folding-deoptimized sequence.

Using the above described methods the present inventors have uncovered potential polynucleotide sequences for Dengue viral genomes. DNA sequences encoding same are presented in SEQ ID NOs: 1671-1734. It will be appreciated that the present inventors contemplate sequences which are at least 80%, 85%, 90%, 91%, 92%, 93%, 94%, 95%, 96%, 97%, 98% and 99%, homologous to said sequences.

Any of the methods described herein can be embodied in many forms. For example, it can be embodied in on a tangible medium such as a computer for performing the method operations. It can be embodied on a computer readable medium, comprising computer readable instructions for carrying out the method operations. It can also be embodied in an electronic device having digital computer capabilities arranged to run the computer program on the tangible medium or execute the instruction on a computer readable medium.

Computer programs implementing the method according to some embodiments of this invention can commonly be distributed to users on a distribution medium such as, but not limited to, CD-ROM, flash memory devices, flash drives, or, in some embodiments, drives accessible by means of network communication, over the internet (e.g., within a cloud environment), or over a cellular network. From the distribution medium, the computer programs can be copied to a hard disk or a similar intermediate storage medium. The computer programs can be run by loading the computer instructions either from their distribution medium or their intermediate storage medium into the execution memory of the computer, configuring the computer to act in accordance with the method of this invention. Computer programs implementing the method according to some embodiments of this invention can also be executed by one or more data processors that belong to a cloud computing environment. All these operations are well-known to those skilled in the art of computer systems. Data used and/or provided by the method of the present embodiments can be transmitted by means of network communication, over the internet, over a cellular network or over any type of network, suitable for data transmission.

It is to be understood that, unless otherwise defined, the operations described hereinbelow can be executed either contemporaneously or sequentially in many combinations or orders of execution. Specifically, the ordering of the flowchart diagrams is not to be considered as limiting. For example, two or more operations, appearing in the following description or in the flowchart diagrams in a particular order, can be executed in a different order (e.g., a reverse order) or substantially contemporaneously. Additionally, several operations described below are optional and may not be executed.

There are various computer programs which can be used to analyze the secondary structure of RNA (i.e. the folding energy profile). According to a particular embodiment, the computer program is Vienna (v. 2.1.9) package RNAfold function with default parameters. This function predicts the minimum free energy and the associated secondary structure for the input RNA sequence using a dynamic programming based on the thermodynamic nearest-neighbor approach (the Zucker algorithm. Other computer programs which may be used to predict secondary structure include but are not limited to CentroidFold, CentroidHomfold, Context Fold, CONTRAfold, CyloFold, IPknot, KineFold, Mfold, Pknots, PknotsRG, pKiss, RNA123, RNAshapes, RNA structure, SARNA-Predict, Sfold, UNAFold, Crumple and Slinking Windows and Assembly.

This invention further provides a method of synthesizing any of the attenuated viruses described herein, the method comprising modifying the codon usage of the protein encoding region of a genome of a virulent virus so as to encode an RNA having a sufficient change in folding energy at sites of evolutionarily conserved RNA structure so as to bring about attenuation of the viral genome.

In certain embodiments of the instant methods, the modifying is guided by computer-based algorithms that permit design of a viral genome by varying the codon usage such that there is a sufficient change in folding energy at localized sites of evolutionarily conserved RNA secondary structure so as to bring about attenuation of the viral genome.

Such computer-based algorithms select and exchange codons encoding the same amino acid at sites of evolutionarily conserved RNA secondary structure and computationally determines whether folding energy at the sites is changed by the exchanging.

According to some embodiments, the selecting and exchanging is repeated until the folding energy is changed by a maximum possible level per each position.

Additionally, or alternatively, the selecting and exchanging is repeated until the folding energy is changed by a maximum possible level at a predetermined number of positions (e.g. between 3 and 500, or up to 10% of the genome).

Generally, modifications are performed to a point at which the virus can still be grown in some cell lines (including lines specifically engineered to be permissive for a particular virus), but where the virus is avirulent in a normal animal or human. Such avirulent viruses are excellent candidates for either a killed or live vaccine since they encode exactly the same proteins as the fully virulent virus and accordingly provoke exactly the same immune response as the fully virulent virus. In addition, the process described herein offers the prospect for fine tuning the level of attenuation; that is, it provides the capacity to design synthetic viral genomes whose secondary structure is deoptimized to a roughly predictable extent. Design, synthesis, and production of viral particles is achievable in a timeframe of weeks once the genome sequence is known, which has important advantages for the production of vaccines in potential emergencies. Furthermore, the attenuated viruses are expected to have virtually no potential to revert to virulence because of the extremely large numbers of deleterious nucleotide changes involved. This method may be generally applicable to a wide range of viruses, requiring only knowledge of the viral genome sequence and a reverse genetics system for any particular virus.

Methods of modifying viral genomes are known in the art and employ molecular biology techniques such as in vitro transcription, reverse transcription, polymerase chain reaction, restriction digestion, cloning etc.

Detailed descriptions of conventional methods, such as those employed in the construction of recombinant plasmids, transfection of host cells with viral constructs, polymerase chain reaction (PCR), and immunological techniques can be obtained from numerous publications, including Sambrook et al. (1989) and Coligan et al. (1994).

When the viral genome is an RNA genome, they may be isolated from virions or from infected cells, converted to DNA ("cDNA") by the enzyme reverse transcriptase, possibly modified as desired, and reverted, usually via the RNA intermediate, back into infectious viral particles. Most commonly, the entire cDNA copy of the genome is cloned immediately downstream of a phage T7 RNA polymerase promoter that allows the in vitro synthesis of genome RNA, which is then transfected into cells for generation of virus (van der Wert, et al., 1986). Alternatively, the same DNA plasmid may be transfected into cells expressing the T7 RNA polymerase in the cytoplasm.

In certain embodiments the modifying is achieved by de novo synthesis of DNA containing the synonymous codons and substitution of the corresponding region of the genome with the synthesized DNA. In further embodiments, the entire genome is is substituted with the synthesized DNA. In still further embodiments, a portion of the genome is substituted with the synthesized DNA.

The present invention provides a vaccine composition for inducing a protective immune response in a subject comprising any of the attenuated viruses described herein and a pharmaceutically acceptable carrier.

It should be understood that an attenuated virus of the invention, where used to elicit a protective immune response (i.e. immunize) in a subject or to prevent a subject from becoming afflicted with a virus-associated disease, is administered to the subject in the form of a composition additionally comprising a pharmaceutically acceptable carrier. Pharmaceutically acceptable carriers are well known to those skilled in the art and include, but are not limited to, one or more of 0.01-0. IM and preferably 0.05M phosphate buffer, phosphate-buffered saline (PBS), or 0.9% saline. Such carriers also include aqueous or non-aqueous solutions, suspensions, and emulsions. Aqueous carriers include water, alcoholic/aqueous solutions, emulsions or suspensions, saline and buffered media. Examples of non-aqueous solvents are propylene glycol, polyethylene glycol, vegetable oils such as olive oil, and injectable organic esters such as ethyl oleate. Parenteral vehicles include sodium chloride solution, Ringer's dextrose, dextrose and sodium chloride, lactated Ringer's and fixed oils. Intravenous vehicles include fluid and nutrient replenishers, electrolyte replenishers such as those based on Ringer's dextrose, and the like. Solid compositions may comprise nontoxic solid carriers such as, for example, glucose, sucrose, mannitol, sorbitol, lactose, starch, magnesium stearate, cellulose or cellulose derivatives, sodium carbonate and magnesium carbonate. For administration in an aerosol, such as for pulmonary and/or intranasal delivery, an agent or composition is preferably formulated with a nontoxic surfactant, for example, esters or partial esters of C6 to C22 fatty acids or natural glycerides, and a propellant. Additional carriers such as lecithin may be included to facilitate intranasal delivery. Pharmaceutically acceptable carriers can further comprise minor amounts of auxiliary substances such as wetting or emulsifying agents, preservatives and other additives, such as, for example, antimicrobials, antioxidants and chelating agents, which enhance the shelf life and/or effectiveness of the active ingredients. The instant compositions can, as is well known in the art, be formulated so as to provide quick, sustained or delayed release of the active ingredient after administration to a subject.

This invention also provides a modified host cell line specially isolated or engineered to be permissive for an attenuated virus that is non-viable in a wild type host cell. Since the attenuated virus cannot grow in normal (wild type) host cells, it is absolutely dependent on the specific helper cell line for growth. This provides a very high level of safety for the generation of virus for vaccine production.

In addition, the present invention provides a method for eliciting a protective immune response in a subject comprising administering to the subject a prophylactically or therapeutically effective dose of any of the vaccine compositions described herein. This invention also provides a method for preventing a subject from becoming afflicted with a virus-associated disease comprising administering to the subject a prophylactically effective dose of any of the instant vaccine compositions. In embodiments of the above methods, the subject has been exposed to a pathogenic virus. "Exposed" to a pathogenic virus means contact with the virus such that infection could result.

The invention further provides a method for delaying the onset, or slowing the rate of progression, of a virus-associated disease in a virus-infected subject comprising administering to the subject a therapeutically effective dose of any of the instant vaccine compositions.

As used herein, "administering" means delivering using any of the various methods and delivery systems known to those skilled in the art. Administering can be performed, for example, intraperitoneally, intracerebrally, intravenously, orally, transmucosally, subcutaneously, transdermally, intradermally, intramuscularly, topically, parenterally, via implant, intrathecally, intralymphatically, intralesionally, pericardially, or epidurally. An agent or composition may also be administered in an aerosol, such as for pulmonary and/or intranasal delivery. Administering may be performed, for example, once, a plurality of times, and/or over one or more extended periods.

Eliciting a protective immune response in a subject can be accomplished, for example, by administering a primary dose of a vaccine to a subject, followed after a suitable period of time by one or more subsequent administrations of the vaccine. A suitable period of time between administrations of the vaccine may readily be determined by one skilled in the art, and is usually on the order of several weeks to months. The present invention is not limited, however, to any particular method, route or frequency of administration.

A "subject" refers to any animal or artificially modified animal. Animals include, but are not limited to, humans, non-human primates, cows, horses, sheep, pigs, dogs, cats, rabbits, ferrets, rodents such as mice, rats and guinea pigs, and birds. Artificially modified animals include, but are not limited to, SCID mice with human immune systems, and CD155tg transgenic mice expressing the human polio virus receptor CD 155. In a preferred embodiment, the subject is a human. Preferred embodiments of birds are domesticated poultry species, including, but not limited to, chickens, turkeys, ducks, and geese.

A "prophylactically effective dose" is any amount of a vaccine that, when administered to a subject prone to viral infection or prone to affliction with a virus-associated disorder, induces in the subject an immune response that protects the subject from becoming infected by the virus or afflicted with the disorder. "Protecting" the subject means either reducing the likelihood of the subject's becoming infected with the virus, or lessening the likelihood of the disorder's onset in the subject, by at least two-fold, preferably at least tenfold. For example, if a subject has a 1% chance of becoming infected with a virus, a two-fold reduction in the likelihood of the subject becoming infected with the virus would result in the subject having a 0.5% chance of becoming infected with the virus. Most preferably, a "prophylactically effective dose" induces in the subject an immune response that completely prevents the subject from becoming infected by the virus or prevents the onset of the disorder in the subject entirely.

As used herein, a "therapeutically effective dose" is any amount of a vaccine that, when administered to a subject afflicted with a disorder against which the vaccine is effective, induces in the subject an immune response that causes the subject to experience a reduction, remission or regression of the disorder and/or its symptoms. In preferred embodiments, recurrence of the disorder and/or its symptoms is prevented. In other preferred embodiments, the subject is cured of the disorder and/or its symptoms.

Certain embodiments of any of the instant immunization and therapeutic methods further comprise administering to the subject at least one adjuvant. An "adjuvant" shall mean any agent suitable for enhancing the immunogenicity of an antigen and boosting an immune response in a subject. Numerous adjuvants, including particulate adjuvants, suitable for use with both protein- and nucleic acid-based vaccines, and methods of combining adjuvants with antigens, are well known to those skilled in the art. Suitable adjuvants for nucleic acid based vaccines include, but are not limited to, Quil A, imiquimod, resiquimod, and interleukin-12 delivered in purified protein or nucleic acid form. Adjuvants suitable for use with protein immunization include, but are not limited to, alum, Freund's incomplete adjuvant (FIA), saponin, Quil A, and QS-21. [0182]. The invention also provides a kit for immunization of a subject with an attenuated virus of the invention. The kit comprises the attenuated virus, a pharmaceutically acceptable carrier, an applicator, and an instructional material for the use thereof. In further embodiments, the attenuated virus may be one or more poliovirus, one or more rhinovirus, one or more influenza virus, etc. More than one virus may be preferred where it is desirable to immunize a host against a number of different isolates of a particular virus. The invention includes other embodiments of kits that are known to those skilled in the art. The instructions can provide any information that is useful for directing the administration of the attenuated viruses.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range but also out of the range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for is brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al., (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Culture of Animal Cells—A Manual of Basic Technique" by Freshney, Wiley-Liss, N.Y. (1994), Third Edition; "Current Protocols in Immunology" Volumes I-III Coligan J. E., ed. (1994); Stites et al., (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Materials and Methods

Data Preparation:

1,670 complete coding sequences of 4 DENVserotypes (651, 615, 356, 45 strains in serotypes 1-4 respectively) were downloaded.

We first translated the nucleotide coding regions and then aligned the resulting amino acid sequences by Clustal Omega package [2] with default parameters. To obtain the multiple alignment of corresponding nucleotide sequences we mapped the aligned amino acids back to the nucleotide sequences basing on the original nucleotide composition of each genome.

Genome Randomization Models:

To investigate selection for folding energy, FE values were compared with corresponding sequence-randomized controls which preserve certain nonrandom features of the naturally occurring sequences. To exclude the possibility that the obtained signals were simply due to amino acid selection pressure (i.e., selection on the protein sequence), as opposed to selection for the folding strength, we restricted our randomized variants to maintain the amino acids order and content (and thus the encoded protein), by sampling from the set of synonymous codons for each amino acid position. To model evolutionary constraints (not necessary related to folding) imposed on synonymous variability in different genomic positions (e.g. mutational bias) we maintained the distribution of synonymous codons (and thus nucleotides) for each column in the interserotype multiple alignment matrix (matrix containing aligned sequences of 4 serotypes). This was achieved by random permutations of synonymous codons for each column in the alignment matrix; in the case of multiple amino acids in a column, each amino acid was permuted separately (FIG. 1B). In this way, for each amino acid the same 'vertical' codon frequencies as in the original alignment matrix (but in a different order) were obtained.

To model the composition of nucleotide pairs which are argued to have an important effect on formation of secondary structures, a model that preserves both the amino acids order and content, and the frequencies distribution of 16 possible pairs of adjacent nucleotides (dinucleotides) for each sequence separately was used. Although efficient methods exist for preserving the amino acids (e.g. permutation of synonymous codons) or the dinucleotides content (e.g. random generation of an Euler path in a De Bruijn-like graph, whose edges represent the dinucleotides [3]) separately, it has been difficult to combine them for satisfying both of the constraints. To overcome these difficulties, we used an elegant algorithm proposed in [4] which is based on a multivariate Boltzmann sampling scheme, initially introduced in the context of enumerative combinatorics. This algorithm produces random variants which feature both correct dinucleotide frequencies and coding capacity while being generated with provably uniform probability. We used the original source code which can be found in csb-dotcsdotmcgilldotca/sparcs.

For each one of 1,670 wild-type sequences, we computed 1,000 randomizations basing on each one of the randomization models, resulting in more than 3 million variants.

Local Folding Energy Profiles:

Free folding energy (FE) is a thermodynamic energy involved in maintaining a secondary structure available to perform physical work while being released, and thus is characterized by non-positive values. mRNA secondary structure is believed to be in the most stable conformation when minimum amount of free energy is exerted (the FE obtains the most negative value).

The local folding energy profiles (FE-profiles) were constructed by applying a 39 nt length sliding window to a genomic sequence (FIG. 1C): in each step the FE of a local subsequence enclosed by the corresponding window was calculated by Vienna (v. 2.1.9) package RNAfold function with default parameters [5]. This function predicts the minimum free energy and the associated secondary structure for the input RNA sequence using a dynamic programming based on the thermodynamic nearest-neighbor approach (the Zucker algorithm) [6-8].

Folding Energy Significance Test:

In order to assess the statistical significance of the folding strength in a particular position in a sequence, we compared the FE values in this position with the FE values in the corresponding position in each one of the randomized variants by calculating an empiric p-value—a proportion of the randomized values as extreme as in the wild type. Positions with FE related p-value<0.05 were defined as having a "suspected" FE related signal; due to a high false discovery rate (Benjamini-Hochberg approach) of FE signals in individual sequences we went further and compared the positions of suspected signals across different genomes.

Conservation of Local Folding Signals.

Due to genetic variability on the one hand, and possible inaccuracies in sequencing and multiple alignment on the other, positions selected for a significant strong (weak) folding in different genomes may be shifted one with respect to the other. To account for these possible displacements when quantifying the conservation of FE related signals across different sequences, we defined a Signal Conservation Index (SCI) at a particular position as a percentage of different aligned sequences which have at least one signal inside a 5 nt length genomic neighborhood of this position (FIGS. 1C, E). SCI takes a range of values between 0 and 1: the higher the value—the more different sequences have FE related signals inside the corresponding neighborhood (higher signal conservation), the lower—the less sequences have FE related signals in common (lower signal conservation). A vector of SCI values in all positions along the coding regions (Signal Conservation Profile) was calculated by applying a 5 nt sliding window to the matrix of aligned FE-profiles (for each serotype and folding signal direction separately), and calculating at each step the corresponding signal conservation index.

Positions with significantly high FE related signal conservation were identified by comparing the wild type SCI values in each position to the SCI values from the corresponding positions in 1000 randomized signal conservation profiles (generated basing on suspected signals identified in 1000 randomized alignments via the OVR model). Those positions with significantly conserved signals (p-value<0.001 with respect to randomized selection conservation values, Benjamini-Hochberg false discovery rate=0.001) which had conservation levels higher than achieved in all corresponding randomized variants were defined as positions that undergo a conserved evolutionary selection for strong/weak folding (FE-selected positions).

The resulting positions are not independent: parts of them belong to intersecting genomic regions and could be possibly attributed to the same or partially-overlapping folding elements. Therefore we defined clusters of FE-selected positions; each cluster consists of all positions with significant signal conservation such that the distance between two consecutive positions in a cluster is no more than 44 nt. According to this definition positions within a particular cluster correspond to partially—overlapping genomic windows) 39 nt folding windows+5 nt offset used in signal conservation analysis); in contrast positions belonging to different clusters are thought as independent with respect to the performed local FE analysis.

We emphasize that conservation of FE related signals was analyzed for each serotype, and folding signal direction separately; specifically, in each case we accounted for positions selected for only one folding direction, either strong or weak. Moreover, the analysis of signal conservation was performed with respect to the evolutionary-constrained model only, since (in contrast to the dinucleotide-preservation or any other model based on a single sequence) it takes into consideration the co-evolution of viral variants and their phylogenetic dependencies.

One-Versus-Rest (OVR) Model:

In order to estimate the expected number of suspected FE related signals (p-value<0.05) in random and in order to generate a null model for estimating the statistical significance of FE signal conservation in different positions, we simulated FE suspected signals in randomized variants according to the following procedure named One-Versus-Rest (OVR) model: for each one of the N randomized variants corresponding to a specific wild-type sequence, we identified iteratively its FE-related suspected signals with respect to the rest of the N−1 random variants (FIG. 1D). We then used the obtained sets of the randomized FE signals to construct the randomized signal conservation profiles: each randomized profile was generated by picking (without repetition) a single one-versus-rest randomized set of selected positions for each wild type sequence (resulting in a randomized alignment variant) and then applying the methodology for computing signal conservation levels as described above.

Normalized Entropy as a Measure for Sequence Variability.

We defined the nucleotide/synonymous variability at a position i in the nucleotides/protein multiple alignment as Shannon entropy of a distribution on nucleotides/synonymous codons corresponding to the consensus amino acid, normalized by the maximal possible 2n entropy value possible in the given position (this measure was also, independently, introduced, in [9]):

$$V_i = -\frac{\sum_{j=1}^{n} p_j \log_2(p_j)}{\log_2 n}$$

here n is the number of distinct elements in the corresponding alphabet; and $p_j$ are their relative frequencies (in the case of nucleotide variability, n=4, i.e. the number of different possible nucleotides; for synonymous variability n is the number of different synonymous codons corresponding to the consensus amino acid in this position).

This variability measure takes values between 0 and 1, and describes how dispersed the distribution of the alphabet elements is: higher values correspond to more uniform nucleotide/codon usage; lower values correspond to more biased nucleotide/codon usage, indicating that some nucleotides/synonymous codons are preferred.

The variability measure was computed for each serotype separately. The synonymous variability index was computed based on the consensus amino acid (the most frequent amino acid) in each position in the multiple alignments. In order to neutralize biases due to poor high number of indels and low consensus values (high amino acid variability), we filtered out positions with consensus levels of less than 90%, and number of gaps of more than 10% (resulting in ~4%, 6%, 3%, 3% filtered positions in serotypes 1-4 respectively). In addition, positions corresponding to singleton amino acids Methionine and Tryptophan (with a natural absence of variability) were excluded.

The variability profiles were constructed by applying a 44 nt sliding window along to the alignment and averaging at each step the nucleotide/synonymous variability values at positions within the corresponding window. The window size was defined in a way that each such window matches the 39 nt genomic region in which the folding for the corresponding positions was predicted+a 5 nt allowed shift used in FE signals conservation analysis (FIG. 1C).

The z-score normalized synonymous variability was constructed by computing in each position a z-score with respect to 1000 variants based on randomized multiple alignments (each randomized alignment was constructed by taking a single, amino acids order preserving, random variant of each wild-type genome):

$$V_{z\text{-}score} = \frac{V - \mu}{\sigma}$$

($\mu/\sigma$—mean/s.t.d of randomized variability values at a particular position).

Software.

Multiple alignments were performed with Clustal Omega package (v.1.2.0). Folding energies were predicted with RNAfold function from Vienna package (v.2.1.9) adapted by us to work with sliding windows. Other computations were performed using Matlab® software (MathWorks Inc.). For high performance computing, a Linux based cluster system was employed.

Results

The different general stages of the exemplified analyses appear in FIGS. 1A-E.

1,670 coding regions of different genomes from four DENV serotypes were downloaded and aligned (FIG. 1A I-II). For each coding region, reference sets of 1000 randomized variants that maintain some of the fundamental properties of the original sequences (FIG. 1A III) were generated.

To assess accurately the statistical significance of the predicted folding energies we employed a reference model that ensures that the reported results cannot be explained by the amino acid composition of the encoded proteins and/or the evolutionary, phylogenetically dependent pressure on synonymous codons along the coding regions (evolutionary-constrained model). To this aim, we designed randomized variants (a Null model) that preserved both the amino acids order of the wild type sequences and the column-wise frequencies of synonymous codons at each position along their alignment (FIG. 1B).

In addition, to make sure that the obtained folding signals were not mainly a consequence of disrupted stacking base-pairs we compared our results with a randomization model designed to maintain both the encoded protein and the distribution of frequencies of pairs of adjacent nucleotides (dinucleotides-constrained model).

Local folding energy profiles (FE-profiles) were computed for each wild-type and randomized sequence (FIGS. 1A IV, C).

To identify positions along the coding regions that were possibly selected during the course of viral evolution for significantly strong/weak folding (more/less negative FE), we investigated the position-wise statistical differences between the FE-profiles corresponding to the wild type sequences and FE-profiles of their randomized variants (FIG. 1A VI). For each sequence we considered the "suspected" positions for which the FE values were found to be lower/higher than in 5% of the corresponding randomized variants (i.e. positions with empiric FE associated p-value<0.05) and analyzed their tendency to maintain the folding related signals across different viral strains (FIGS. 1A VII, C, E); in addition the role of sequence variability in this phenomenon was investigated (FIG. 1A V).

To assess the expected number of suspected positions in randomized variants we designed the following procedure, named One-Versus-Rest (OVR) model: in each randomized FE-profile, the suspected folding related signals were identified by a position-wise comparison to the rest of the randomized FE-profiles from the same wild-type origin (FIG. 1D). Conceptually, the average number of randomized suspected positions (FE associated p-value<0.05) obtained in this procedure evaluates the expected number of false positive signals and therefore can serve for an empirical false discovery rate estimation.

In addition, the suspected positions identified in randomized variants (randomized suspected positions) were used to obtain a null model for FE signal conservation analysis.

Evidence that the DENV Coding Regions Contain Hundreds of Positions that are Likely to be Selected for Conserved Strong or Weak Local Folding Structures.

Folding energy was estimated in all genomic windows of length 39 nt (motivated by an approximated average ribosomal footprint [10] and in the order of magnitude of various intracellular complexes [11] and functional mRNA structures [12,13]) within the coding region of each viral genome, and the resulting values were used to construct local FE-profiles: each position in a profile contained a FE value computed in a window starting at this position.

FE-profile of each wild-type sequence was compared in a position-wise manner to the FE-profiles of the corresponding evolutionary-constrained randomized variants (randomized FE profiles); positions with p-value<0.05 were defined as "suspected" to have significantly more/less negative FE in comparison to random (i.e. carrying a "suspected" folding related signal).

During the second step, aiming at distinguishing signals that are due to mutation bias from signals that undergo an evolutionary selection, we went further to identify positions along the coding region which tend to maintain FE related signals in different viral variants. Such positions may belong to the same orthologous functional elements (i.e. elements conserved in various genomes with respect to their function but not necessarily conserved with respect to their sequence) and could have important implications for viral fitness.

To quantify the tendency of a particular position in the coding region to maintain a conserved signal, we computed the percentage of different sequences for which at least one suspected folding related signal was identified within a 5 nucleotides neighborhood of this position (FIGS. 1C, E). For convenience we termed this measure Signal Conservation Index (SCI). The SCI values range between 0 (none of the sequences have any local FE signal around the position) and 1 (100% of the sequences have a FE signal within the allowed neighborhood).

To assess the statistical significance of FE signal conservation, we compared the wild-type SCI values to a reference model based on 1000 randomized alignments in which selection conservation was computed with respect to the randomized suspected signals detected via the OVR procedure. As a result, we identified positions with a statistically significant FE signal conservation (SCI associated p-value<0.001; Benjamini-Hochberg false discovery rate 0.001); those of them with conservation levels higher than 0.20, 0.20, 0.21, 0.42 (thresholds which are equal to the maximal SCI values achieved in random in serotypes 1-4 correspondingly for both folding signal directions) were defined as positions that are likely to undergo a conserved evolutionary selection for strong/weak folding (shortly, FE-selected positions).

Profiles of SCI values along the coding regions are shown in FIG. 2A. Positions with a significantly conserved strong folding signal were found to constitute 53, 65, 62, 66 different clusters in serotypes 1-4 correspondingly; likewise, weak local folding signal was identified as conserved in positions grouped in 49, 73, 58, 65 clusters. Each cluster was comprised of positions with significantly conserved FE related signals predicted in intersecting 44 nt genomic windows (39 nt folding window size+5 nt is allowed shift in signal position in conservation analysis); these positions could be possibly attributed to the same or partially-overlapping folding elements.

The resulting conservation levels were found to be spread over a wide range of values; specifically 20%-90% of FE-selected positions (depending on serotype and the direction of the folding signal) possessed SCI values greater than 0.5 (meaning that the FE related signals in these positions were maintained in more than 50% of the sequences); in 2%-7% of FE-selected positions the conservation levels where higher than 0.9 (meaning a conservation of the FE signal therein in more than 90% sequences; FIG. 2B).

The total amounts of FE-selected positions in all serotypes were found to be significantly higher (p-value<0.001; on average 40-100 folds, depending on serotype and the direction of the folding signal) than those obtained in the randomized variants (FIG. 3). Moreover, as was stated above, the maximal SCI value achieved in random is 0.2-0.42 while in wild-type 35%-100% of FE-selected positions possessed higher conservation levels (depending on serotype and the direction of the folding signal).

Conserved Selection for Strong/Weak Folding Related Signals Cannot be Explained Basing Only on Dinucleotide Composition.

Arguably, the dinucleotide content is important when assessing the predicted free energy of RNA secondary structures [14-16]. In particular, it was suggested that disruption of naturally occurring biases in dinucleotide frequencies in genomic sequences of different organisms have been common sources of erroneous conclusions in previous studies [16,17]. To make sure that the presence of excess local secondary structure in coding regions of mRNA is not merely an artifact resulting from the failure to control for dinucleotide composition we verified the robustness of our findings by analyzing a dinucleotide-constrained randomization model controlling for the distribution of dinucleotide frequencies (see Materials and Methods section).

We found that as many as 60%, 52%, 49%, 34% of positions with significantly conserved signals related to strong folding and 62%, 58%, 43%, 44% of positions possessing weak folding signal conservation (identified with respect to evolutionary-constrained model for serotypes 1-4 correspondingly) overlapped with FE conserved signals identified with respect to dinucleotide-preserving randomization model (FIG. 3), and this overlap was not likely to appear in random (p-value<0.001 basing on conservation levels in 1000 randomized alignments; no overlap was observed in the case of the randomized genomes).

This result is further supporting the conjecture that dinucleotides alone cannot explain the majority of obtained FE signals identified with respect to the evolutionary-constrained model, and thus at least some of them undergo a conserved evolutionary selection for strong/weak folding and are not just artifacts of disrupting natural occurring biases in pairs of adjacent nucleotides.

The Regions with Significantly Conserved Strong/Weak Folding Signals Cannot be Explained Based Only on Sequence Conservation.

Although the nature of the evolutionary-constrained model excludes the possibility of significant FE signal conservation in regions with a low sequence variability across different viral variants (in such case the randomization will not have enough degrees of freedom to produce a sufficient variety of variants for a reliable statistical analysis) we decided to additionally explore the plausibility that conservation of folding signals may be a 'side effect' of conserved nucleotides composition or preference for specific synonymous codons (due to reasons not directly related to folding).

To this aim we quantified the variability among different sequences along the coding region, once with respect to a preference for synonymous codons and once with respect to nucleotides content, by considering an entropy based measure in each position in the coding region (see Material and Methods); this measure returns a value which ranges between 0 (no variability; i.e. a preference for a certain nucleotide/synonymous codon) and 1 (maximal variability; i.e. a uniform usage of all nucleotides/synonymous codons).

To assess the relationship between the conservation levels of FE related signals and sequence variability therein, we calculated Spearman correlations between: 1) the signal conservation profiles and 2) the nucleotide/synonymous variability profiles constructed by locally averaging the corresponding variability values in all 44 nt genomic intervals (the size of the intervals was chosen to match the 39 nt local windows in which the FE was predicted+the allowed 5 nt position shift in signal conservation analysis; see the Methods section and FIG. 1C); we also calculated, in a similar manner, the correlations between 1) the signal conservation profiles and 2) the variability profiles which were normalized with respect to their randomized variants (based on 1000 randomized alignments) to obtain z-score values (see Materials and Methods).

We found that the correlation between the FE signal conservation, and nucleotide and synonymous variability/z-score normalized variability is too low to conclude that regions with lower variability tend to have higher tendency for FE signal conservation. Specifically the correlation values were found to be confined in a narrow [−0.1 0.1] interval around zero for different types of variability profiles (FIG. 4B); i.e. less than 10% of the variance in signal conservation variable can be explained by the variability values.

These results support the conjecture that the conservation of FE related signals is not necessarily and only due to a preference of specific synonymous codons or conserved nucleotide content, and cannot be solely explained by the low sequence variability, thus supporting the evidence for a direct, conserved selection on positions for strong/weak folding.

Example 2

Comparison of Folding and Codon-Pair Deoptimized Sequences

For a particular wild-type sequence, we compared its folding deoptimized variant and a variant created according to the previously disclosed codon-pair deoptimization method [1]. The comparison was performed as follows:

a. A particular wild-type DENV-2 coding sequence was chosen b. Intervals with significantly preserved selection (Preserved intervals) for strong folding and intervals with significantly preserved selection for weak folding were identified as described in the specification. Specifically, the selection preservation index was computed in 5 nt length SPI-intervals over all sequences in DENV serotype 2.

c. Clusters of Preserved intervals for strong and weak folding were computed as in 6; specifically the threshold D on distance between 5' ends of two consecutive intervals was set to 44 (39 nt—length windows in local folding energy was predicted+5 nt—offset used in selection preservation analysis), resulting in 65 clusters of strong folding Preserved Intervals and 73 clusters for weak folding Preserved Intervals.

d. For each cluster, one representative 39 nt window was chosen; resulting in 65 windows for strong folding, and 73 windows for weak folding (henceforth, we refer these intervals as selected windows).

e. The selected windows were deoptimized with respect to their folding strength; windows selected with respect to strong folding were manipulated to have a weaker folding, and vice versa—windows selected with respect to weak folding were manipulated to have a stronger folding. The deoptimization was performed via the Simulated Annealing optimization heuristics constrained to preserve the amino acid content and order of the wild-type windows.

f. For each selected window we computed the difference between the wild-type folding energy and the energy after folding deoptimization:

$$\Delta G_{FE\text{-}deopt} = FE_{wt} - FE_{FE\text{-}deopt}$$

g. A Codon-pair deoptimized variant of the wildtype sequence (a) was computed according to the previously disclosed procedure [1]. Specifically the Codon-Pair Score 0.026 of the wild-type sequence was deoptimized to −0.467 (the more negative the score is—the more underrepresented codon pairs with respect to human genome are used).

h. Folding energy profiles of the wild-type (a) and codon-pair deoptimized (g) sequences were computed in 39 nt sliding windows (see 4):

$$F_{wildtype} = [F_{wt,1}, \ldots, F_{wt,i}, F_{wt,i+m}, \ldots, F_{wt,k}]$$

$$F_{CP\text{-}deopt} = [F_{CP\text{-}deopt,1}, \ldots, F_{CP\text{-}deopt,i}, F_{CP\text{-}deopt,i+m}, \ldots, F_{CP\text{-}deopt,k}]$$

i. Differences between folding energy profiles (h) of the wild-type (a) and codon-pair deoptimized (g) sequences were computed in a position-wise manner:

$$\Delta G_{CP\text{-}deopt} = [(F_{wt,1} - F_{CP\text{-}deopt,1}), \ldots, \ldots, (F_{wt,k} - F_{CP\text{-}deopt,k})]$$

j. The distributions of changes in folding energies between the wild-type and folding-deoptimized ($\Delta G_{FE\text{-}deopt}$ in selected windows), and between wild-type and codon-pair deoptimized ($\Delta G_{CP\text{-}deopt}$ in all windows) were analyzed. As can be seen in FIGS. 8A-B, the $\Delta G_{FE\text{-}deopt}$ and $\Delta G_{CP\text{-}deopt}$ have different distributions with different mean values.

Specifically:
For weak to strong deoptimization: only ~1% of windows for which folding in codon pair deoptimized sequence is weaker than in wildtype have $\Delta G_{CP\text{-}deopt} < -8$. In contrast, ~95% of 73 folding-deoptimized windows have $\Delta G_{FE\text{-}deopt} < -8$.

For strong to weak deoptimization: only ~11% of windows for which folding in codon pair deoptimized sequence is stronger than in wildtype have $\Delta G_{CP\text{-}deopt} > 5$. In contrast, ~57% of 65 selected windows have $\Delta G_{FE\text{-}deopt} > 5$.

Example 3

Algorithms

Algorithm 1 (Farthest Sequence Sampling):
Input:—a set of sequences S equipped with the diversity metric $d_S$;
an initial sequence $s_0 \in S$;
the desired number of selected sequences N;
Output:—sampled sequences $S' = \{s_1, \ldots, s_N\}$;
1. $S' = \{s1\}$;
2. while $|S'| < N$
2.1 Find the farthest sequence from S':
$s' = \arg\max_{s \in S}\{d_s(s,S)\} = \arg\max_{s_i \in S'}\{d_s(s,s_i)\}$
2.2 Update the set of selected sequences: $S' \leftarrow S' \cup \{s'\}$;
3. end Algorithm 2 (HCUB Randomization Model):
Input:—a wild type sequence $s = [s_1, \ldots, s_n]$;
Output:—a randomized sequence $r = [r_1, \ldots, r_n]$;
1. For each amino acid A, compute its synonymous codons density function $F_A$ $$F_A(C_{A,i}) = q_{A,i}, \sum_{i=1}^{m} q_{A,i} = 1$$

2.1. $x \sim U(0,1)$
2.2. If $x < q_{Ai.1}$ return $Ci = C_{Ai.1}$ else if $x < q_{Ai.1} + q_{Ai.2}$ return $Ci = C_{Ai.2}$ ... else if $x < q_{Ai.1} + \ldots + q_{Ai,m-1}$ return $Ci = C_{Ai,m-1}$ else return $Ci = C_{Ai,m}$
2.3. $r \leftarrow r + Ci$
where $C_{A,i}$, $i = 1 \ldots m$, the m-th—synonymous codons of the amino acid A
2. For each i-th codon in s (coding amino acid Ai):
3. return $r = [C1, \ldots, Ci, \ldots, Ck]$ Algorithm 3 (VCUB Randomization Mode):
Input:—a matrix of aligned wild type sequence $$S = \begin{bmatrix} c_{11} & \cdots & c_{1k} \\ \vdots & \ddots & \vdots \\ c_{N1} & \cdots & c_{Nk} \end{bmatrix},$$

where $c_{ij}$ is the codon in position j in sequence i, N is the number of sequences and K is the number of codons in aligned sequences (each row is comprised of codons of a single sequence)
Output:—a matrix of VCUB randomized sequences:

$$R = \begin{bmatrix} r_{11} & \cdots & r_{1k} \\ \vdots & \ddots & \vdots \\ r_{N1} & \cdots & r_{Nk} \end{bmatrix}$$

where $r_{ij}$ is the codon in position j in sequence i
1. For i-th column in S containing the i-th codon of each sequence ($1 \leq i \leq K$):
  1.1 For each amino acid, $A_{ij}$, that corresponds to the i-th column and appears in a subset $S_j$ of sequences ($S_j$—integer indexes of the corresponding sequences):
    1.1.1. generate a random permutation of integers in Sj, $\sigma_{Sj}$;
    1.1.2. For k=1 to |Sj|

$$r_{i,S_j(k)} = \sigma_{S_j}(k)$$

1.2. $R \leftarrow [R + r_i]$, where $r_i$ is column i of randomized codons
2. Return the matrix R of VCUB randomized sequences.

Algorithm 4 (Local Genomic Feature Significance Test):
Input:—a LGF profile of the wild type sequence S (the test statistics), $$F = [f_1, \ldots, f_k],$$

a collection of N LGF profiles calculated on N randomizations of S (the null model), $$\tilde{F} = [\tilde{F}_1 \ldots \tilde{F}_k] = \begin{bmatrix} \tilde{f}_{11} & \cdots & \tilde{f}_{1k} \\ \vdots & \ddots & \vdots \\ \tilde{f}_{n1} & \cdots & \tilde{f}_{nk} \end{bmatrix}$$

Output:—p-value at position i, p,
1. Compute the KST test on $\tilde{F}_i$: check the null hypothesis whether the sample of N i.i.d random variables $\tilde{F}_i = [\tilde{f}_{i1}, \ldots, \tilde{f}_{in}]^T$ is drawn from a Normal distribution $N(\hat{\mu}_i, \hat{\sigma}_i)$, where $\hat{\mu}_i$ and $\hat{\sigma}_i$ are the sample mean and standard deviation unbiased estimators correspondingly.
2. If KST accepted:
  2.1. $\tilde{F}_i$ is approximated by an underlying Normal distribution, and the one sided p-value is calculated analytically by:

$$p_i \leftarrow p_i^a = P(\tilde{F}_i \leq f_i) \sim N(f_i, \hat{\mu}_i, \hat{\sigma}_i)$$

else
2.2 calculate empiric p-value approximation:

$$p_i \leftarrow p_i^e = P(\tilde{F}_i < f) = \frac{1}{n}\sum_{k=1}^{n} I\{f_{ki} < x\}$$

3. Return $p_i$

The p-value approximations in this algorithm all correspond to a left-tailed test. Conversion to the right-tailed test and the two-tailed test is in all cases is mutatis mutandis.

Algorithm 5 (Selection Concentration Profile):
Input:—Selection Matrix $$S = \begin{bmatrix} \delta_{11} & \cdots & \delta_{1k} \\ \vdots & \ddots & \vdots \\ \delta_{n1} & \cdots & \delta_{nk} \end{bmatrix}, \delta_{ij} = \begin{cases} 1, & \text{position } j \text{ is salient in profile } i \\ 0, & \text{otherwise} \end{cases}$$

Output:—Selection Preservation Profile $$SCI = [SCI_1, \ldots, SCI_{k-w+1}]$$

1. For each position i:
  1.1. Compute selection conservation submatrix corresponding to the window starting at position i:

$$S_i = \begin{bmatrix} \delta_{1,i} & \cdots & \delta_{1,max(i+w-1,k)} \\ \vdots & \vdots & \vdots \\ \delta_{n,i} & \cdots & \delta_{n,max(i+w-1,k)} \end{bmatrix}$$

1.2. Calculate the Selection Concentration Index:

$$SCI_i = \frac{1}{n}\sum_{k=1}^{n}\sum_{j=i}^{max(i+w-1,k)} \delta_{k,j}$$

1.3. $SCI[i] \leftarrow SCI_i$
2. Return SCI

Algorithm 6 (Selection Preservation Profile):
Input:—Selection Matrix $$S = \begin{bmatrix} \delta_{11} & \cdots & \delta_{1k} \\ \vdots & \ddots & \vdots \\ \delta_{n1} & \cdots & \delta_{nk} \end{bmatrix}, \delta_{ij} = \begin{cases} 1, & \text{position } j \text{ is salient in profile } i \\ 0, & \text{otherwise} \end{cases}$$

Output:—Selection Preservation Profile $$SPI = [SPI_1, \ldots, SPI_{k-w+1}]$$

1. For each position i:
   1.1. Compute selection conservation submatrix corresponding to the window starting at position i:

$$S_i = \begin{bmatrix} \delta_{1,i} & \cdots & \delta_{1,max(i+w-1,k)} \\ \vdots & \vdots & \vdots \\ \delta_{n,i} & \cdots & \delta_{n,max(i+w-1,k)} \end{bmatrix}$$

1.2. Calculate the Selection Preservation Index:

$$SPI_i = \frac{r}{n}$$

1.3. $SPI[i] \leftarrow SPI_i$
2. Return SCI

One-Versus-Rest (OVR) Random Tests
Let P be some LGF profile and $\tilde{P} = \{\tilde{P}^k\}_{k=1}^n$ a set of its n randomized variants. Let $T=G(S)$ be a vector (scalar) of some local (global) statistics on a set $S=S(P,\tilde{P})$ of single-sequence evolutionary salient local regions. The following algorithm tests the statistical significance of T:

Algorithm 7 (OVR)
Input:
a profile P;
a set of its random variants $\tilde{P} = \{\tilde{P}^k\}_{k=1}^n$;
Output:
OVR p-value;
1. Initialize: $T[k]=0, \forall k \in [1, \ldots, n]$
2. For k from 1 to n
2.1. Identify salient regions in random variant k:

$$\tilde{S}^k \leftarrow S(P^k, \tilde{P} \backslash P^k)$$

2.2. Calculate statistics vector (scalar) T on salient regions:

$$\tilde{T}[k] \leftarrow G(\tilde{S}^k)$$

end

3. Estimate p-value:

$$p_{OVR} \leftarrow \frac{1}{n}\sum_{k=1}^{n} I\{\tilde{T}[k] > T\}$$

(if T is a vector, the statistical significance is estimates for each coordinate separately):
In some embodiments T is a Selection Concentration or Selection Preservation profile and G is a function for calculating SCI or SPI correspondingly.

Algorithm 8 (Significance Rank Aggregation)
Input:—a collection of MLGF profiles, $P=\{P_1, \ldots, P_M\}$
a collection of salient regions for each profile
Output:—top k salient regions
1. Initialize a L—length Votes vector:
   Aggregated rank$\leftarrow$[0 0 0, . . . , 0], where L is profile length;
2. For each profile $P_i$
   2.1. Votes$\leftarrow$[0 0 0, . . . , 0], where L is profile length;
   2.2. The number of votes given to a position is determined by its rank in a sorted profile and by the profile length L. A position will receive L votes if it is ranked first, L−1 points if it is ranked second, L−3 for being ranked in the third place, and so on:
      Ri$\leftarrow$[sort positions in the profile corresponding to salient regions according to their significance levels in a descending order+append the remaining positions]=L-length vector of ranked positions
   2.3. Votes(Ri)$\leftarrow$[L L−1 L−2 . . . 1]
      (positions which do not correspond to salient regions get vote-0)
   2.4. Aggregated rank$\leftarrow$Aggregated rank+Votes(Ri)
3. Return the top_k_salient_regions$\leftarrow$k positions with top ranks in the Aggregated rank vector.

Algorithm 9 (Construction of Live Attenuated Genomes that Maximize/Minimize Folding Energy in Selected Regions while Maintaining the Encoded Protein and the Codon Usage Bias)
Input:—a wild type genome sequence $s^{wt}$
a collection of top K salient regions in $s^{wt}$ (with respect to strong and weak folding)
Output:—a library V of K candidate genomes of live attenuated vaccine 1. Initialize the library of live attenuated genomes:

$V \leftarrow \{\emptyset\}$

2. For $i^{th}$ salient region, $s_i^{wt}$ (1≤i≤K):

2.1. Initialize the $i^{th}$ live attenuated genome with the wild-type sequence:

$v_i \leftarrow s^{wt}$ 2.2. If $s_i^{wt}$ is selected with respect to strong folding:

$$s_i^* = \underset{s \in \{A,C,G,T\}^{L_i}}{\operatorname{argmax}} FE(s)$$

Else if $s_i^{wt}$ is selected with respect to weak folding:

$$s_i^* = \underset{s \in \{A,C,G,T\}^{L_i}}{\operatorname{argmin}} FE(s)$$

Subjected to $$\text{Protein}(s_i^*) = \text{Protein}(s_i^{wt})$$

And $$\text{CUB}(s_i^*) = \text{CUB}(s_i^{wt})$$

Where,
- $L_i$—size of the region (in nucleotides)
- $\{A, C, G, T\}^{L_i}$—a space of nucleotide sequences of size $L_i$
- $s_i^{wt} \in (A, C, G, T)^{L_i}$—wild-type nucleotide sequence corresponding to the $i^{th}$ salient region
- $s_i^* \in (A, C, G, T)^{L_i}$—nucleotide sequence that maximizes the folding energy of the $i^{th}$ salient region subjected to constraints.
- FE(s), Protein(s), CUB(s)—Folding energy, protein and codon usage bias encoded by a nucleotide sequence s.

2.3. Replace the nucleotides in the $i^{th}$ salient region with the nucleotides that solve the optimization problem in 2.2.:

$$v_i(s_i^{wt})\leftarrow s_i^*$$

Sequence outside the $i^{th}$ region is not modified.

2.4. Add the $i^{th}$ live attenuated genome to the library:

$$V\leftarrow V\cup v_i$$

3. return V

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

REFERENCES

1. Coleman J R, Papamichail D, Skiena S, Futcher B, Wimmer E, et al. (2008) Virus attenuation by genome-scale changes in codon pair bias. Science (New York, N.Y.) 320: 1784-1787. doi:10.1126/science.1155761.
2. Sievers F, Wilm A, Dineen D, Gibson T J, Karplus K, et al. (2011) Fast, scalable generation of high-quality protein multiple sequence alignments using Clustal Omega. Molecular systems biology 7: 539. doi:10.1038/msb.2011.75.
3. Altschul S, Erickson B (1985) Significance of nucleotide sequence alignments: a method for random sequence permutation that preserves dinucleotide and codon usage. Mol Biol Evol 2: 526-538.
4. Zhang Y, Ponty Y, Blanchette M, Lécuyer E, Waldispühl J (2013) SPARCS: a web server to analyze (un)structured regions in coding RNA sequences. Nucleic acids research 41: W480-5. doi:10.1093/nar/gkt461.
5. Lorenz R, Bernhart S H, Höner Zu Siederdissen C, Tafer H, Flamm C, et al. (2011) ViennaRNA Package 2.0. Algorithms for molecular biology: AMB 6: 26. doi:10.1186/1748-7188-6-26.
6. Mathews D H (2006) Revolutions in RNA secondary structure prediction. Journal of molecular biology 359: 526-532. doi:10.1016/j.jmb.2006.01.067.
7. Mathews D H, Sabina J, Zuker M, Turner D H (1999) Expanded sequence dependence of thermodynamic parameters improves prediction of RNA secondary structure. Journal of molecular biology 288: 911-940. doi:0.1006/jmbi. 1999.2700.
8. Wuchty S, Fontana W, Hofacker I L, Schuster P (1999) Complete suboptimal folding of RNA and the stability of secondary structures. Biopolymers 49: 145-165. doi:10.1002/(SICI) 1097-0282(199902)49:2<145::AID-BIP4>3.0.CO;2-G.
9. Zanini F, Neber R A (2013) Quantifying selection against synonymous mutations in HIV-1 env evolution. Journal of virology 87: 11843-11850. doi:10.1128/JVI.01529-13.
10. Jackson R J (2005) Alternative mechanisms of initiating translation of mammalian mRNAs. Biochemical Society transactions 33: 1231-1241. doi:10.1042/BST20051231.
11. Selby C P, Drapkin R, Reinberg D, Sancar A (1997) RNA polymerase II stalled at a thymine dimer: footprint and effect on excision repair. Nucleic acids research 25: 787-793.
12. Tuller T, Zur H (2014) Multiple roles of the coding sequence 5' end in gene expression regulation. Nucleic Acids Research 43: 13-28. doi:10.1093/ar/gku1313.
13. Alcaraz-Estrada S L, Yocupicio-Monioy M, del Angel R M (2010) Insights into dengue virus genome replication. Future Virology 5: 575-592. doi:10.2217/fvl.10.49.
14. Zuker M, Stiegler P (1981) Optimal computer folding of large RNA sequences using thermodynamics and auxiliary information. Nucleic acids research 9: 133-148.
15. Nussinov R (1984) Strong doublet preferences in nucleotide sequences and DNA geometry. Journal of molecular evolution 20: 111-119.
16. Workman C, Krogh A (1999) No evidence that mRNAs have lower folding free energies than random sequences with the same dinucleotide distribution. Nucleic acids research 27: 4816-4822.
17. Rivas E, Eddy S R (2000) Secondary structure alone is generally not statistically significant for the detection of noncoding RNAs. Bioinformatics (Oxford, England) 16: 583-605.

SEQUENCE LISTING (1734 sequences)

SEQ ID NO: 1 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaattggtgatggcttttatagcattcctaagatttctagccatacctccaacagcaggaattttggctagatggggctcattcaagaagaatggagcgatcaaagtgttacggggtttcaagaaagaaatctcaaacatgttgaacataatgaacaggaggaaaagatctgtgaccatgctcctcatgctgctgcccacagccctggcgttccatctgaccacccgagggggagagccgcacatgatagttagcaagcaggaaagaggaaaatcacttttgtttaagacctctgcaggtgtcaacatgtgcacccttattgcaatggatttgggagagttatgtgaggacacaatgacctacaaatgcccccggatcactgagacggaaccagatgacgttgactgttggtgcaatgccacggagacatgggtgacctatggaacatgttctcaaactggtgaacaccgacgagacaaacgttccgtcgcactggcaccacacgtagggcttggtctagaaacaagaaccgaaacgtggatgtcctctgaaggcgcttggaaacaaatacaaaaagtggagacctgggctctgagacacccaggattcacggtgatagccctttttctagcacatgccataggaacatccatcacccagaaagggatcatttttattttgctgatgctggtaactccatccatggccatgcggtgcgtgggaataggcaacagagacttcgtggaaggactgtcaggagctacgtgggtggatgtggtactggagcatggaagttgcgtcactaccatggcaaaagacaaaccaacactggacattgaactcttgaagacggaggtcacaaaccctgccgtcctgcgcaaactgtgcattgaagctaaaatatcaaacaccaccaccgattcgagatgtccaacacaaggagaagccacgctggtggaagaacaggacacgaactttgtgtgtcgacgaacgttcgtggacagaggctggggcaatggttgtgggctattcggaaaaggtagcttaataacgtgtgctaagtttaagtgtgtgacaaaactggaaggaaagatagtccaatatgaaaacttaaaatattcagtgatagtcaccgtacacactggagaccagcaccaagttggaaatgagaccacagaacatggaacaactgcaaccataacacctcaagctcccacgtcggaaatacagctgacagactacggagctctaacattggattgttcacctagaacagggctagactttaatgagatggtgttgttgacaatgaaaaaaaaatcatggctcgtccacaaacaatggtttctagacttaccactgccttggacctcgggggcttcaacatcccaagagacttggaatagacaagacttgctggtcacatttaagacagctcatgcaaaaaagcaggaagtagtcgtactaggatcacaagaaggagcaatgcacactgcgttgactggagcgacagaaatccaaacgtctggaacgacaacaatttttgcaggacacctgaaatgcagattaaaaatggataaactgattttaaaagggatgtcatatgtaatgtgcacagggtcattcaagttagagaaggaagtggctgagacccagcatggaactgttctagtgcaggttaaatacgaaggaacagatgcaccatgcaagatccccttctcgtcccaagatgagaagggagtaacccagaatgggagattgataacagccaaccccatagtcactgacaaagaaaaaccagtcaacattgaagcggagccaccttttggtgagagctacattgtggtaggagcaggtgaaaaagctttgaaactaagctggttcaagaagggaagcagtatagggaaaatgtttgaagcaactgcccgtggagcacgaaggatggccatcctgggagacactgcatgggacttcggttctataggaggggtgttcacgtctgtgggaaaactgatacaccagatttttgggactgcgtatggagttttgttcagcggtgtttcttggaccatgaagataggaatagggattctgctgacatggctaggattaaactcaaggagcacgtccctttcaatgacgtgtatcgcagttggcatggtcacactgtacctaggagtcatggttcaggcggactcgggatgtgtaatcaactggaaaggcagagaactcaaatgtggaagcggcatttttgtcaccaatgaagtccacacctggacagagcaatataaattccaggccgactcccctaagagactatcagcggccattgggaaggcatgggaggagggtgtgtgtggaattcgatcagccactcgtctcgagaacatcatgtggaagcaaatatcaaatgaattaaaccacatcttacttgaaaatgacatgaaatttacagtggtcgtaggagacgttagtggaatcttggcccaaggaaagaaaatgattaggccacaacccatggaacacaaatactcgtggaaaagctggggaaaagccaaaatcataggagcagatgtacagaataccaccttcatcatcgacggcccaaacaccccagaatgccctgataaccaaagagcatggaacatttgggaagttgaagactatggatttggaattttcacgacaaacatatggttgaaattgcgtgactcctacactcaagtgtgtgaccaccggctaatgtcagctgccatcaaggatagcaaagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagatatatggaggaccaatatctcagcacaactacagaccaggatatttcacacaaacagcagggccgtggcacttgggcaagttagaactagattttgatttatgtgaaggtaccactgttgttgtggatgaacattgtggaaatcgaggaccatctcttagaaccacaacagtcacaggaaagacaatccatgaatggtgctgtagatcttgcacgttaccccccctacgtttcaaaggagaagacgggtgctggtacggcatggaaatcagaccagtcaaggagaaggaagagaacctagttaagtcaatggtctctgcagggtcaggagaagtggacagtttttcactaggactgctatgcatatcaataatgatcgaagaggtaatgagatccagatggagcagaaaaatgctgatgactggaacattggctgtgttcctccttctcacaatgggacaattgacatggaatgatctgatcaggctatgtatcatggttggagccaacgcttcagacaagatggggatgggaacaacgtacctagctttgatggccactttcagaatgagaccaatgttcgcagtcgggctactgtttcgcagattaacatctagagaagttcttcttcttacagttggattgagtctggtggcatctgtagaactaccaaattccttagaggagctaggggatggacttgcaatgggcatcatgatgttgaaattactgactgattttcagtcacatcagctatgggctaccttgctgtctttaacatttgtcaaaacaactttttcattgcactatgcatggaagacaatggctatgatactgtcaattgtatctctcttccctttatgcctgtccacgacttctcaaaaaacaacatggcttccggtgttgctgggatctcttggatgcaaaccactaaccatgtttcttataacagaaaacaaaatctggggaaggaaaagctggcctctcaatgaaggaattatggctgttggaatagttagcattcttctaagttcacttctcaagaatgatgtgccactagctggcccactaatagctggaggcatgctaatagcatgttatgtcatatctggaagctcggccgatttatcactggagaaagcggctgaggtctcctgggaagaagaagcagaacactctggtgcctcacacaacatactagtggaggtccaagatgatggaaccatgaagataaaggatgaagagagagatgacacactcaccattctcctcaaagcaactctgctagcaatctcaggggtatacccaatgtcaataccggcgaccctctttgtgtggtatttttggcagaaaaagaaacagagatcaggagtgctatgggacacacccagccctccagaagtggaaagagcagtccttgatgatggcatttatagaattctccaaagaggattgttgggcaggtctcaagtaggagtaggagtttttcaagaaggcgtgttccacacaatgtggcacgtcaccaggggagctgtcctcatgtaccaagggaagagactggaaccaagttgggccagtgtcaaaaaagacttgatctcatatggaggaggttggaggtttcaaggatcctggaacgcgggagaagaagtgcaggtgattgctgttgaaccggggaagaaccccaaaaatgtacagacagcgccgggtaccttcaagacccctgaaggcgaagttggagccatagctctagactttaaacccggcacatctggatctcctatcgtgaacagagagggaaaaatagtaggtctttatggaaatggagtggtgacaacaagtggtacctacgtcagtgccatagctcaagctaaagcatcacaagaagggcctctaccagagattgaggacgaggtgtttaggaaaagaaacttaacaataatggacctacatccaggatcgggaaaaacaagaagataccttccagccatagtccgtgaggccataaaaagaaagctgcgcacgctagtcttagctcccacaagagttgtcgcttctgaaatggcagaggcgctcaagggaatgccaataaggtatcagacaacagcagtgaagagtgaacacacgggaaaggagatagttgaccttatgtgtcacgccactttcactatgcgtctcctgtctcctgtgagagttcccaattataatatgattatcatggatgaagcacattttaccgatccagccagcatagcagccagagggtatatctcaacccgagtgggtatgggtgaagcagctgcgattttcatgacagccactccccccggatcggtggaggcctttccacagagcaatgcagttatccaagatgaggaaagagacattcctgaaagatcatggaactcaggctatgactggatcactgatttcccaggtaaaacagtctggtttgttccaagcatcaaatcaggaaatgacattgccaactgtttaagaaagaatgggaaacgggtggtccaattgagcagaaaaacttttgacactgagtaccagaaaacaaaaaataacgactgggactatgttgtcacaacagacatatccgaaatgggagcaaacttccgagccgacagggtaatagacccgaggcggtgcctgaaaccggtaatactaaaagatggcccagagcgtgtcattctagccggaccgatgccagtgactgtggctagcgccgcccagaggagaggaagaattggaaggaaccaaaataaggaaggcgatcagtatatttacatgggacagcctctaaacaatgatgaggaccacgcccattggacagaagcaaaaatgctccttgacaacataaacacaccagaagggattatcccagccctctttgagccggagagagaaaagagtgcagcaatagacggggaatacagactacggggtgaagcgaggaaaacgttcgtggagctcatgagaagaggagatctacctgtctggctatcctacaaagttgcctcagaaggcttccagtactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaacgccttggacaatctggttatgttgcacaactctgaacaaggaggaaaagcctatagacacgccatggaagaactaccagacaccatagaaacgttaatgctcctagctttgatagctgtgctgactggtggagtgacgttgttcttcctatcaggaaggggtctaggaaaaacatccattggcctactctgcgtgattgcctcaagtgcactgttatggatggccagtgtggaaccccattggatagcggcctctatcatactggagttctttctgatggtgttgcttattccagagccggacagacagcgcactccacaagacaaccagctagcatacgtggtgataggtctgttattcatgatattgacagtggcagccaatgagatgggattactggaaaccacaaagaaggacctggggattggtcatgcagctgctgaaaaccaccatcatgctgcaatgctggacgtagacctacatccagcttcagcctggactctctatgcagtggccacaacaattatcactcccatgatgagacacacaattgaaaacacaacggcaaatatttccctgacagctattgcaaaccaggcagctatattgatgggacttgacaagggatggccaatatcaaagatggacataggagttccacttctcgccttggggtgctattctcaggtgaacccgctgacgctgacagcggcggtattgatgctagtggctcattatgccataattggacccggactgcaagcaaaagctactagagaagctcaaaaaaggacagcagccggaataatgaaaaacccaactgtcgacgggatcgttgcaatagatttggaccctgtggtttacgatgcaaaatttgaaaaacagctaggccaaataatgttgttgatactttgcacatcacagatcctcctgatgcggaccacatgggccttgtgtgaatccatcacactagccactggacctctgactacgctttgggagggatctccaggaaaattctggaacaccacgatagcggtgtccatggcaaacatttttaggggaagttatctagcaggagcaggtctggccttttcattaatgaaatctctaggaggaggtaggagaggcacgggagcccaaggggaaacactgggagaaaaatggaaaagacagctaaaccaattgagcaagtcagaattcaacacttacaaaaggagtgggattatagaggtggatagatctgaagccaaagaggggttaaaaagaggagaaacgactaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacgaaaggaggacctggacatgaggaaccaatcccaatggcaacctatggatggaacctagtaaagctatactccgggaaagatgtattctttacaccacctgagaaatgtgacaccctcttgtgtgatattggtgagtcctctccgaacccaactatagaagaaggaagaacgttacgtgttctaaagatggtggaaccatggctcagaggaaaccaattttgcataaaaattctaaatccctatatgccgagtgtggtagaaactttggagcaaatgcaaagaaaacatggaggaatgctagtgcgaaatccactctcaagaaactccactcatgaaatgtactgggtttcatgtggaacaggaaacattgtgtcagcagtaaacatgacatctagaatgctgctaaatcgattcacaatggctcacaggaagccaacatatgaaagagacgtggacttaggcgctggaacaagacatgtggcagtagaaccagaggtggccaacctagatatcattggccagaggatagagaatataaaaaatgaacacaaatcaacatggcattatgatgaggacaatccatacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacagagggtgtttaaagagaaagttgacacgcgtacaccaaaagcgaaacgaggcacagcacaaattatggaggtgacagccaggtggttatggggttttctctctagaaacaaaaaacccagaatctgcacaagagaggagttcacaagaaaagtcaggtcaaacgcagctattggagcagtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaattaggagagttcggaaaggcaaaaggaagtcgcgcaatatggtacatgtggttgggagcgcgctttttagagtttgaagcccttggtttcatgaatgaagatcactggttcagcagagagaattcactcagtggagtggaaggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctattggccacgtcaatctttaagctaacctaccaaaacaaggtagtaagggtgcagagaccagcgaaaaatggaaccgtgatggatgtcatatccagacgtgaccagagaggaagtggacaggttggaacctatggcttaaacaccttcaccaacatggaggcccaactaataagacaaatggagtctgagggaatcttttcacccagcgaattggaaaccccaaatctagccgaaagagtcctcgactggttgaaaaaacatggcaccgagaggctgaaaagaatggcaatcagtggagatgactgtgtggtgaaaccaatcgatgacagatttgcaacagccttaacagctttgaatgacatgggaaaggtaagaaaagacataccgcaatgggaaccttcaaaaggatggaatgattggcaacaagtgcctttctgttcacaccatttccaccagctgattatgaaggatgggagggagatagtggtgccatgccgcaaccaagatgaacttgtaggtagggccagagtatcacaaggcgccggatggagcttgagagaaactgcatgcctaggcaagtcatatgcacaaatgtggcagctgatgtacttccacaggagagacttgagattagcggctaatgctatctgttcagccgttccagttgattgggtcccaaccagccgcaccacctggtcgatccatgcccaccatcaatggatgacaacagaagacatgttgtcagtgtggaatagggtttggatagaggaaaacccatggatggaggacaagactcatgtgtccagttgggaagacgttccatacctaggaaaaagggaagatcaatggtgtggttccctaataggcttaacagcacgagccacctgggccaccaacatacaagtggccataaaccaagtgagaaggctcattgggaatgagaattatctagacttcatgacatcaatgaagagattcaaaaacgagagtgatcccgaaggggcactctggtaa

SEQ ID NO: 2 - DNA, 10179 bp, Dengue virus
atgaacaaccaacggaagaagacgggtcgaccgtctttcaatatgctgaaacgcgcgagaaaccgcgtgtcaactggttcacagttggcgaagagattctcaaaaggattgctctcaggccaaggacccatgaaattggtgatggcttttatagcattcctaagatttctagccatacccccaacagcaggaattttggctagatggagctcattcaagaagaatggagcgatcaaagtgttacggggtttcaaaaaagagatctcaagcatgttgaacataatgaacaggagaaagagatccgtgaccatgctccttatgctgctgcccacagccctggcgttccatttgaccacacgagggggagagccacacatgatagttagcaaacaggaaagaggaaagtcactcttgtttaagacctctgcaggtgtcaacatgtgcaccctcattgcaatggatttgggagagttatgtgaggacacaatgacctataaatgcccccggatcactgaagcggaaccagatgatgttgattgctggtgcaatgccacagacacatgggtgacctatgggacgtgttctcaaactggcgaacaccgacgggataaacgttctgtcgcattggccccacacgtggggcttggtctagaaacaagaaccgaaacgtggatgtcctctgaaggcgcctggaaacaaatacaaaaagtggagacttgggctttgagacacccaggattcacggtgatagccctttttttagcacatgccataggaacatccattactcagaaagggatcattttcattttgctgatgctggtgacaccatcaatggccatgcgatgcgtgggaataggcaacagagacttcgttgaaggactgtcaggagcaacgtgggtggatgtggtactggagcatggaagctgcgtcaccaccatggcaaaaaataaaccaacattggacattgaactcttgaagacggaggtcacgaaccctgccgtcttgcgcaaactgtgcattgaagccaaaatatcaaacaccactaccgattcaagatgcccaacacaaggagaagctacactggtggaagaacaagacgcgaactttgtgtgtcgacgaacatttgtggacagaggctggggtaatggttgtggactattcgggaaaggaagcttactgacgtgtgctaagtttaagtgtgtgacaaaacttgaaggaaagatagttcaatatgaaaacttaaaatattcggtgatagtcactgtccatactggggaccagcaccaggtgggaaatgagactacagaacatggaacaattgcaaccataacacctcaagctcccacgtcggaaatacagctgactgactacggagctcttacattggactgctcacctagaacagggctggactttaatgagatggtgctgttgacaatgaaagaaaaatcatggcttgtccacaaacaatggtttctagacttaccactgccttggacctcgggggcttcaacatctcaagagacttggaacagacaagatttgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaagggacgtcatatgtgatgtgcacaggctcatttaagttagagaaggaagtggctgagacccagcatggaactgtcctagtgcaggttaagtacgaaggaacagatgcaccatgcaagattcccttttcaacccaagatgagaaaggagtgacccagaatgggagattgataacagccaatcccatagttactgacaaagaaaaaccagtcaacattgagacagaaccaccttttggtgagagctacatcgtagtaggggcgggtgaaaaagctttgaaactaagctggttcaagaaaggaagcagcatagggaaaatgttcgaagctaccgcccgaggagcacgaaggatggctatcctgggagacacagcatgggacttcggttccataggaggggtgttcacatccgtgggaaaattagtacaccaggtttttggaaccgcatatggggtcttgttcagcggtgtttcttggaccatgaaaataggaatagggattctgctgacatggctaggattaaattcaaggagcacgtcactctcgatgacgtgcattgcagttggcatggtcacactgtacctaggagtcatggttcaagcggactcggggtgtgtgatcaactggaagggcagagaactcaaatgtggaagtggcatcttcgtcactaatgaagtccacacttggacagagcaatataaattccaggctgactccccaaaaagactgtcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtgggagacgctaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggattatgggtttggaattttcacgacaaacatatggctgaaattgcgtgactcctacacccaaatgtgtgaccaccggctaatgtcagctgccatcaaggacagcaaggcagtccacgctgacatggggtactggatagaaagtgaaaagaatgagacctggaagctagcgagagcctccttcatagaagtgaagacatgcatctggccaaaatctcacactctatggagcaatggagtcttggaaagtgaaatgataatcccaaagatatatggaggaccaatatctcagcacaactacagaccagggtatttcacacaaacagcagggccatggcacctaggcaagttggaactagactttgatttgtgtgaaggcaccacagttgttgtggatgaacattgtggaaatcgaggtccatctcttagaactacaacagtcacaggaaagacaatccatgaatggtgttgcagatcctgcacgctaccccccttacgcttcaaaggagaagacggatgttggtatggcatggaaatcagaccagttaaggagaaggaagagaatctagtcaggtcaatggtctctgcagggtcaggagaagtggatagtttttcattgggactactatgcgtatcaataatgattgaagaagtgatgagatccagatggagtagaaagatgctgatgactggaacactggctgttttcttccttcttataatgggacaactgacatggaatgatctgattaggttatgcatcatggttggagccaatgtctcagacaggatggggatgggaacaacatacctagccttgatggccactttcaaaatgagaccgatgttcgctgttgggctattatttcgcagactaacatccagagaggttctccttctcacaattggactaagcctggtggcatccgtggagctaccaaattccttagaggagctaggggacggacttgcaatgggcatcatgatgttaaaattattgactgattttcagtcacaccagttatggactaccttactatctctgacattcatcaaaacaactctttcattggattatgcatggaagacaatggctatggtattgtcaatcgtatctctccttcctttatgcctatctacgacctctcaaaaaacaacatggcttccggtgctgttaggatcttttggatgcaaaccactaaccatgtttcttataacagaaaacaaaatctggggaaggaaaagttggcccctcaatgaaggaattatggctgttggaatagtcagcattttactaagttcactcctcaaaaatgatgtgccactagccggcccactaatagctggaggcatgctgatagcatgttacgtcatatccggaagctcagccgatttatcattggagagagcggctgaggtctcctgggaagaagaagcagaacactctggtgcctcacacaatataccagtggaggtccaagatgatggaactatgaaaataaaagatgaagagagagatgacacgctcactatactccttaaagcaactctgttggcagtctcaggggtgtacccaatgtcaataccagcaaccctttttgtgtggtacttttggcagaaaaagaaacagagatcaggagtcttgtgggacacacccagccctccagaagtggaaagagcagttcttgatgatggtatctatagaatcttgcaaagaggactattgggtaggtcccaggtaggagtgggagtttttcaagacggcgtgttccacacaatgtggcatgtcaccaggggggctgtcctcatgtaccaagggaagaggctggaaccaagctgggccagtatcaaaaaagacttgatctcatatggaggaggttggaggtttcaaggatcatggaacacgggagaagaagtacaggtgatagctgttgaaccaggaaaaaacccaaaaaatgtacagacaacgccgggcaccttcaagacccctgaaggtgaagttggagccatagccctagatttcaaacccgggacatctggatctcccatcgtgaacagagagggaaaaatagtaggtctttatggaaatggagtggtgacaacaagtggaacctacgtcagtgccattgcccaagctaaagcatcacaagaagggcctctaccagagattgaggacgaggtgtttaagaaaagaaacctaactataatggacctacatccaggatcaggaaaaacaagaagatatcttccagccatagtccgtgaggccataaaaaggaaactgcgtacgctaattttggctcccacaagagttgtcgcctctgaaatggcagaggcgcttaaaggaatgccaataagatatcagacaacagcagtaaagagtgaacacacaggaagggagatagttgatcttatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcaccgatttcccaggaaaaacagtctggtttgttccaagcatcaaatcaggaaatgacattgccaactgtttaagaaagaacgggaaacgggtgatccaattgagcagaaaaacctttgacactgaataccagaaaacaaaaaacaatgactgggactatgttgtcacaacagacatttccgaaatgggagcaaatttccgggccgacagggtaatagacccaaggcggtgcttgaagccggtaatactaaaagatggcccagagcgcgtcattctagccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgaaccggagagagaaaaaagtgcagcaatagacggggagtacagactgcggggagaagcaaggaaaacgttcgtggagctaatgagaagaggggatctaccagtttggctatcttataaagttgcctcagaaggcttccagtactccgacagaaggtggtgctttgacggggaaaggaacaaccaggtgttggaggagaacatggacgtggagatctggacaaaagaaggagaaagaaagaaattacgacctcgctggttagatgccagaacctactctgatccactggccctgcgcgagtttaaagagttcgcagcaggaagaagaagtgtctcaggtgacctaatattagaaatagggaaacttccacagcatttgacgctaagggcccagaatgctttggacaacttggtcatgttgcacaattctgaacaagggggaagagcctacagacatgctatggaagaattaccagacaccatagaaacattgatgctcctagctttgatagctgtgctgactggtggagtgacgttgtttttcctatcaggaaaaggtctagggaaaacatccattggcctactttgtgtgatggcctcaagtgtactgctatggatggccagtgtagagccccattggatagcggcctccatcatactagagttctttctgatggtgctgctcattccagagccagacagacagcgtactccacaggacaatcagctagcatatgtcgtgataggtttgttattcatgatattgacagtggcagccaatgagatgggattactggaaaccacaaagaaagacctggggattggccatgtagtcgctgaaaaccaccaccatgctacaatgctagatatagacttacatccagcttcagcctggaccctctatgcagtagccacaacaattatcactcccatgatgagacacacaattgaaaacacaacggcaaatatttccctgacagctattgcaaatcaggcggctatattgatgggacttgacaagggatggccaatatcgaagatggacataggagtgccactactcgccttagggtgctattcccaggtgaacccattgacactgacagcggcggtgttgatgttagtggctcattatgccataatcggacctggactgcaagcaaaagctactagagaagcccaaaaaaggacagctgccggaataatgaaaaatccaactgtagacgggattgttgcaatagatttggatcctgtggtttatgatgcaaaatttgaaaaacagctaggccaaataatgttactgatactctgcacatcacagattctcttgatgcggactacatgggccttatgtgaatccatcacactggccactggacccttgaccaccctctgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatctgaagccaaggagggactgaaaagaggagaaacaaccaaacacgcagtgtcgagaggaacagccaaacttaggtggtttgtggagaggaaccttgtgaaaccagaagggaaagtgatagacctcggttgtggaagaggtggctggtcatattattgcgctgggctgaagaaggttacagaagtgaagggatacacaaaaggaggacccggtcatgaggaacctatcccaatggcgacttatggatggaacctggtgaagctacactccgggaaggatgtattctttacaccacctgagaaatgtgacacccttttgtgtgatattggtgaatcctctccgaatccaactatagaagaaggaagaacgttgcgtgtgctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaactctacccatgaaatgtactgggtctcatgtggaacaggaaacattgtgtcggcagtgaacatgacatccagaatgttgctgaatcggttcacaatggctcacaggaagccaacgtatgaaagagacgtggacttgggcgctggaacaagacatgtggcagtggaaccagagatagccaacttagacatcattggccagaggatagagaacataaaaaatgaacacaaatcaacatggcattatgatgaggacaatccatacaaaacatgggcctatcatggatcatatgaggtcaagccatcagggtcagcctcatccatggtgaatggcgtggtgagattgctcaccaaaccatgggatgttatccccatggtcacacaaatagctatgactgacaccacacccttcggacaacagagggtgtttaaagagaaagttgacacacgcacaccaagaccaaaacgaggcacagcacaaattatggaggtgacagctaagtggttgtggggtttcctctctagaaataaaaaacccagaatctgcacaagagaggagttcacaagaaaagttaggtcaaacgcagcaattggagcagtgttcgttgatgaaaaccaatggaactcagcaaaagaagcagtggaagacgaaaggttttgggacctcgtgcacagagagagggagcttcataaacagggaaaatgtgccacgtgtgtctacaatatgatggggaaaagagagaaaaaattaggagagtttggaaaggcaaaaggaagtcgtgcaatatggtacatgtggttgggagcacgctttctagagtttgaagcccttggcttcatgaatgaagaccactggttcagcagggagaattcactcagtggagtggaaggagaaggactacacaaacttggatacatactcagagacatatcaaagattccagggggaaatatgtatgcagatgacacagctggatgggacacaagaataacagaggatgatcttcagaatgaggctaaaatcactgacatcatggagcccgaacatgctctactggctacgtcaatcttcaaactgacctatcaaaataaggtggtaagggtgcaaagaccagcaaaaaatggaaccgtgatggacgttatatccagacgtgaccagagaggaagtggacaggtcggaacttatggcttaaacactttcaccaacatggaggtccaactaataagacaaatggaatctgaaggaatcttttcacccagcgaattggaaacccccaatctagctgagagagttctcgactggttggaaaaacatggcgtcgaaaggttgaaaagaatggcaattagcggagatgactgtgtagtgaaaccaactgatgacaggttcgcagcagctttaacagccctgaatgacatgggaaaagtgagaaaagacataccgcaatgggaaccttcaaaaggatggaatgactggcagcaagtgcctttctgttcacaccatttccaccaactgatcatgaaggatgggagggagatagtggtgccatgccgcaaccaagatgaacttgtaggcagggccagagtatcacaaggcgccggatggagcctgagagaaactgcttgcctaggcaagtcatatgcacaaatgtggcagctgatgtacttccacaggagagatctgagactggcggctaatgctatctgttcagccgttccagttaattgggtcccaaccagccgcaccacctggtcgatccatgcccaccatcaatggatgacaacagaagacatgttatcagtgtggaatagggtttggatagaggaaaacccatggatggaggacaaaactcatgtatccagttgggaagatgttccatacttaggaaaaagggaagatcaatggtgtggatccctgataggcttaacagcaagagccacctgggccaccaacatacaagtggccattaaccaagtgagaaggctcattgggaatgagaattatttggactacatgacatcaatgaagagattcaagaatgagagtgatcctgaaggagccctctggtaa

SEQ ID NO: 3 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggcttttatagcatttctaagatttctagccatacccccaacagcaggaattttggctagatggagctcattcaagaagaatggagcaatcaaagtgttacggggtttcaaaaaagagatctcaagcatgttgaacataatgaacaggaggaaaagatccgtgaccatgctcctcatgctgctgcccacagtcctggctttccatttgaccacacgagggggagagccacacatgatagttagtaagcaggaaagaggaaagtcactcttgttcaagacctctgcaggtgtcaatatgtgcactctcattgcgatggatttgggagagttatgtgaggacacaatgacttacaaatgcccccggatcactgaggcggaaccagatgacgttgactgctggtgcaatgccacagacacatgggtgacctatgggacgtgttctcaaaccggtgaacaccgacgagacaaacgttccgtggcactggccccacacgtgggacttggtctagaaacaagaaccgaaacatggatgtcctctgaaggcgcctggaaacaaatacaaaaagtggagacttgggctttgagacacccaggattcacggtgatagctctttttttagcacatgccataggaacatccatcactcagaaagggatcattttcattctgctgatgctggtaacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaattgtgcattgaagctaaaatatcaaacaccaccaccgattcaagatgtccaacacaaggagaggctacactggtggaagaacaagacgcgaactttgtgtgtcgacgaacggttgtggacagaggctggggcaatggctgcggactatttggaaaaggaagcctactgacgtgtgctaagttcaagtgtgtgacaaaactggaaggaaagatagttcaatatgaaaacttaaaatattcagtgatagtcactgtccacacaggggaccagcaccaggtgggaaacgagactacagaacatggaacaattgcaaccataacacctcaagctcctacgtcggaaatacagttgacagactacggaacccttacactggactgctcacccagaacagggctggactttaatgaggtggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaagcaggaagtagtcgtactgggatcacaggaaggagcaatgcacactgcgttgaccggggcgacagaaatccagacgtcaggaacgacaacaatctttgcaggacacctgaaatgcagattaaaaatggataaactgactttaaaagggatgtcatatgtgatgtgcacaggctcatttaagctagagaaggaagtggctgagacccagcatgggactgtcctagtgcaggttaaatacgaaggaacagatgcgccatgcaagatccccttttcgacccaagatgagaaaggagtgacccagaatgggagattgataacagccaatcccatagttactgacaaagaaaaaccaatcaacattgagacagaaccaccttttggtgagagctacatcatagtaggggcaggtgaaaaagctttgaaactaagctggttcaagaaaggaagcagcatagggaaaatgttcgaagcaatcgcccgaggagcacgaaggatggctatcctgggagacaccgcatgggacttcggctctataggaggagtgtttacgtctgtgggaaaattggtacaccaggtttttggaaccgcatacggggtcctgttcagcggcgtttcttggaccatgaaaataggaatagggattctgctgacatggttgggattaaattcaaggagcgcgtcgctttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccagggaaaaaaaatgatcaggccacaacccatggaacacaaatactcatggaaaagctggggaaaagccaagatcataggagcagacacacagaataccaccttcatcatcgacggcccagacactccagaatgccccgatgaccaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtcaagacatgcatttggccgaaatcccacactctatggagtaatggagttttggaaagtgaaatgataatcccaaagatatatggaggaccaatatctcagcacaattacagaccagggtatttcacacaaacagcagggccatggcacctaggtaagttggaattggattttgacttgtgtgaaggcaccacagttgttgtggatgaacattgtggaaatcgaggtccatctctcagaaccacaacagtcacaggaaagataatccatgaatggtgttgcagatcctgcacgttaccccccttacgcttcagaggagaagacggatgttggtatggcatggaaataagaccagttaaggagaaggaggagaacctagttaggtcaatggtctctgcagggtcaggagaagtggacagtttttcattgggaatactatgcgtatcaataatgattgaagaagtgatgagatccagatggagcagaaaaatgctgatgactggaacactggctgttttcctccttcttataatgggacaactgacatggaatgatctgattaggctatgcatcatggttggagctaatgcttctgacaggatggggatgggaacaacgtacctagccttgatggccacttttaaaatgagaccaatgttcgccgttgggttattatttcgcagactaacatccagagaggttcttcttctcacgattggattaagcctggtggcatccgtggagctaccaaattctttggaggagctaggggatgggcttgcaatgggtatcatgatgttaaaattattgactgaatttcagccacaccagttatggaccaccttactgtctctgacatttatcaaaacaactctttcattggattatgcatggaagacaatggctatggtactgtcaatcgtatctctctttcctttatgtctgtctacgacctcccaaaaaacaacatggcttccggtgctgttaggatcttttggatgcaaaccattaaccatgtttcttataacagaaaacaaaatctggggaagaaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcactggagaaagcggctgaggtatcctgggaagaagaagcagaacactctggtacctcacacaacatattagtagaggtccaagatgatggaactatgaaaataaaagatgaagagagggatgacacactcaccatcctcctcaaagcaactctgctggcagtctcaggagtgtacccaatgtcaataccagcaactctttttgtgtggtatttttggcagaaaaagaaacagagatcaggagtgttatgggacacacccagccctccggaagtggaaagagcagttcttgacgatggcatctatagaatcttgcaaagaggactgttgggcaggtcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcccgaaggtgaagttggagccatagctctagattttaaacccggcacatctggatctcccattgtgaacagagagggaaaaatagtaggtctttatggaaatggagtggtgacaacaagtggaacctacgtcagtgccattgcccaagctaaagcatcacaagaagggcccctaccagagattgaggacgaagtgtttaagaaaagaaacttaacaataatggacctgcatccaggatcaggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtaaagagtgaacacacaggaagggagatagttgatctcatgtgccacgccacttttaccatgcgtctcttatctccagtgagagttcccaattacaacatgattatcatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtgatccaattgagcagaaaaacctttgacacagagtaccagaaaacaaaaaacaatgactgggactatgttgtcacaacagacatttccgaaatgggggcaaatttcagggccgacagggtaatagacccaaggcggtgcttgaaaccggtaatatcaaaagatggtccagagcgcgtcattctagctggaccgatgccagtgactgtggctagtgctgcccagaggagaggaagaattggaaggaaccaaaacaaggaaggtgatcagtatgtttacatgggacagcctttaaataatgatgaggatcacgctcattggacagaagcaaaaatgctccttgacaacataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgatgctgttcttcctatcaggaaaaggtctagggaaaacatccattggcctgctctgtgtgatggcctcaagcgcactgttatggatggccagtgtggagccccattggatagcggcctccatcatactagagttctttctaatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaccacgttacaatgctggacgtagacctacgtccagcttcagcctggaccctctatgcggtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgctgatgttggtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagattctcttgatgcggaccacatgggccttgtgtgaatccatcacactggctactggacccttgaccactctctgggagggatctccaggaaaattctggaataccacgatagcagtgtccatggcaaacatcttcaggggaagttatctagcaggagcaggtctggccttctcattaatgaaatctctaggaggaggtaggagaggtacgggagctcaaggggaaacactgggagagaaatggaaaagacagttaaaccaactgagcaagtcagaattcaacacctacaaaaggagtgggattatggaggtggacagatctgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacttatggatggaacctagtaaagctacactctggaaaagatgtatttttcataccacctgagaaatgtgatacccttttgtgtgatattggtgagtcctctccgaatccaactatagaagaaggaagaacgttacgtgttctaaagatggtggaaccatggcttagaggaaaccaattctgcataaaaatcctaaatccttacatgccaagtgtggtagaaactctggagcaaatgcaaaggaaacatggagggatgctagtgagaaacccactctcaagaaattccacccatgaaatgtactgggtttcatgtggaacaggaaacattgtgtcggcagtgaacatgacatccagaatgttactgaatcgattcacaatggcgcataggaagccaacatatgaaagagatgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggtcaagccatcaggatcagcctcatctatggtgaatggcgtggtgagattgctcacaaaaccatgggatgttatccccatggtcacacaaatagctatgactgataccacacccttcggacaacagagagtgtttaaagagaaagttgacacgcgcacaccaagagcaaaacgaggcacagcacaaattatggagatgacagcaaaatggttatggggtttcctttccagaaacaaaaaacccagaatctgcacaagagaggagttcataagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgcgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggttcagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattagaaacccctaatctagctgagagagttcttgactggttggaaaaacatggtgccgaaaggctgaaaagaatggcaattagcggagatgattgtgtggtgaaaccaattgatgacaggttcgcaacagccttaatagctctgaatgacatgggaaaagtaagaaaagacataccgcagtgggaaccctcaaaaggatggaatgactggcagcaagtgcctttctgttcacaccatttccaccagctgatcatgaaggatgggagagaaatagtggtgccatgccgcaaccaagatgaacttgtgggcagggctagagtatcacaaggcgccggatggagcctgagagaaactgcttgcctaggcaagtcatacgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatctctgataggcttgacagcgagggccacctgggccaccaacatacaagtagccataaaccaagtgagaaggctcattgggaatgagaattatctagattacatgacatcaatgaagagattcaagaatgagagtgatcccgaaggggcactctggtaa

SEQ ID NO: 4 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggcttttatagcatttctaagatttctagccatacccccaacagcaggaattttggctagatggagctcattcaagaagaatggagcaatcaaagtgttacggggtttcaaaaaagagatctcaagcatgttgaacataatgaacaggaggaaaagatccgtgaccatgctcctcatgctgctgcccacagtcctggctttccatttgaccacacgagggggagagccacacatgatagttagtaagcaggaaagaggaaagtcactcttgttcaagacctctgcaggtgtcaatatgtgcactctcattgcgatggatttgggagagttatgtgaggacacaatgacttacaaatgcccccggatcactgaggcggaaccagatgacgttgactgctggtgcaatgccacagacacatgggtgacctatgggacgtgttctcaaaccggtgaacaccgacgagacaaacgttccgtggcactggccccacacgtgggacttggtctagaaacaagaaccgaaacatggatgtcctctgaaggcgcctggaaacaaatacaaaaagtggagacttgggctttgagacacccaggattcacggtgatagctctttttttagcacatgccataggaacatccatcactcagaaagggatcattttcattctgctgatgctggtaacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaattgtgcattgaagctaaaatatcaaacaccaccaccgattcaagatgtccaacacaaggagaggctacactggtggaagaacaagacgcgaactttgtgtgtcgacgaacggttgtggacagaggctggggcaatggctgcggactatttggaaaaggaagcctactgacgtgtgctaagttcaagtgtgtgacaaaactggaaggaaagatagttcaatatgaaaacttaaaatattcagtgatagtcactgtccacacaggggaccagcaccaggtgggaaacgagactacagaacatggaacaattgcaaccataacacctcaagctcctacgtcggaaatacagttgacagactacggaacccttacactggactgctcacccagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaagcaggaagtagtcgtactgggatcacaggaaggagcaatgcacactgcgttgaccggggcgacagaaatccagacgtcaggaacgacaacaatctttgcaggacacctgaaatgcagattaaaaatggataaactgactttaaaagggatgtcatatgtgatgtgcacaggctcatttaagctagagaaggaagtggctgagacccagcatgggactgtcctagtgcaggttaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcatagtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgtttacgtctgtgggaaaattggtacaccaggtttttggaaccgcatacggggtcctgttcagcggcgtttcttggaccatgaaaataggaatagggattctgctgacatggttgggattaaattcaaggagcgcgtcgctttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaggggaaaaaaatgatcaggccacaacccatggaacacaaatactcatggaaaagctggggaaaagccaagatcataggagcagacacacagaataccaccttcatcatcgacggcccagacactccagaatgccccgatgaccaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtcaagacatgcatttggccgaaatcccacactctatggagtaatggagttttggaaagtgaaatgataatcccaaagatatatggaggaccaatatctcagcacaattacagaccagggtatttcacacaaacagcagggccatggcacctaggtaagttggaattggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatctgattaggctatgcatcatggttggagctaatgcttctgacaggatggggatgggaacaacgtacctagccttgatggctacttttaaaatgagaccaatgttcgccgttgggttattatttcgcagactaacatccagagaggttcttcttctcacgattggattaagcctggtggcatccgtggagctaccaaattctttggaggagctaggggatgggcttgcaatgggtatcatgatgttaaaattattgactgaatttcagccacaccagttatggaccaccttactgtctctgacatttatcaaaacaactctttcattggattatgcatggaagacaatggctatggtactgtcaatcgtatctctctttcctttatgtctgtctacgacctcccaaaaaacaacatggcttccggtgctgttaggatcttttggatgcaaaccattaaccatgtttcttataacagaaaacaaaatctggggaagaaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcactggagaaagcggctgaggtatcctgggaagaagaagcagaacactctggtacctcacacaacatattagtagaggtccaagatgatggaactatgaaaataaaagatgaagagagggatgacacactcaccatcctcctcaaagcaactctgctggcagtctcaggagtgtacccaatgtcaataccagcaactctttttgtgtggtatttttggcagaaaaagaaacagagatcaggagtgttatgggacacacccagccctccggaagtggaaagagcagttcttgacgatggcatctatagaatcttgcaaagaggactgttgggcaggtcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcccgaaggtgaagttggagccatagctctagattttaaacccggcacatctggatctcccattgtgaacagagagggaaaaatagtaggtctttatggaaatggagtggtgacaacaagtggaacctacgtcagtgccattgcccaagctaaagcatcacaagaagggcccctaccagagattgaggacgaagtgtttaagaaaagaaacttaacaataatggacctgcatccaggatcaggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtaaagagtgaacacacaggaagggagatagttgatctcatgtgccacgccacttttaccatgcgtctcttatctccagtgagagttcccaattacaacatgattatcatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtgatccaattgagcagaaaaacctttgacaccgagtaccagaaaacaaaaaacaatgactgggactatgttgtcacaacagacatttccgaaatgggggcaaatttcagggccgacagggtaatagacccaaggcggtgcttgaaaccggtaatattaaaagatggtccagagcgcgtcattctagctggaccgatgccagtgactgtggctagtgctgcccagaggagaggaagaattggaaggaaccaaaacaaggaaggtgatcagtatgtttacatgggacagcctttaaataatgatgaggatcacgctcattggacagaagcaaaaatgctccttgacaacataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgatgctgttcttcctatcaggaaaaggtctagggaaaacatccattggcctgctctgtgtgatggcctcaagcgcactgttatggatggccagtgtggagccccattggatagcggcctccatcatactagagttctttctaatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaccacgttacaatgctggacgtagacctacgtccagcttcagcctggaccctctatgcggtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgctgatgttggtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagattctcttgatgcggaccacatgggccttgtgtgaatccatcacactggctactggacccttgaccactctctgggagggatctccaggaaaattctggaataccacgatagcagtgtccatggcaaacatcttcaggggaagttatctagcaggagcaggtctggccttctcattaatgaaatctctaggaggaggtaggagaggtacgggagctcaaggggaaacactgggagagaaatggaaaagacagttaaaccaactgagcaagtcagaattcaacacctacaaaaggagtgggattatggaggtggacagatctgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacttatggatggaacctagtaaagctacactctggaaaagatgtatttttcataccacctgagaaatgtgatacccttttgtgtgatattggtgagtcctctccgaatccaactatagaagaaggaagaacgttacgtgttctaaagatggtggaaccatggcttagaggaaaccaattctgcataaaaatcctaaatccttacatgccaagtgtggtagaaactctggagcaaatgcaaaggaaacatggagggatgctagtgagaaacccactctcaagaaattccacccatgaaatgtactgggtttcatgtggaacaggaaacattgtgtcggcagtgaacatgacatccagaatgttactgaatcgattcacaatggcgcataggaagccaacatatgaaagagatgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggtcaagccatcaggatcagcctcatctatggtgaatggcgtggtgagattgctcacaaaaccatgggatgttatccccatggtcacacaaatagctatgactgataccacacccttcggacaacagagagtgtttaaagagaaagttgacacgcgcacaccaagagcaaaacgaggcacagcacaaattatggagatgacagcaaaatggttatggggtttcctttccagaaacaaaaaacccagaatctgcacaagagaggagttcataagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgcgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggttcagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattagaaacccctaatctagctgagagagttcttgactggttggaaaaacatggtgccgaaaggctgaaaagaatggcaattagcggagatgattgtgtggtgaaaccaattgatgacaggttcgcaacagccttaatagctctgaatgacatgggaaaagtaagaaaagacataccgcagtgggaaccctcaaaaggatggaatgactggcagcaagtgcctttctgttcacaccatttccaccagctgatcatgaaggatgggagagaaatagtggtgccatgccgcaaccaagatgaacttgtgggcagggctagagtatcacaaggcgccggatggagcctgagagaaactgcttgcctaggcaagtcatacgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatctctgataggcttgacagcgagggccacctgggccaccaacatacaagtagccataaaccaagtgagaaggctcattgggaatgagaattatctagattacatgacatcaatgaagagattcaagaatgagagtgatcccgaaggggcactctggtaa

SEQ ID NO: 5 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcaatcaaagtgttacggggtttcaaaaaagagatctcaagcatgctgaacataatgaacaggaggaaaagatccgtgaccatgctcctcatgctgctgcccacagccctggcgttccatttgaccacacgagggggagagccacacatgatagttagtaagcaggaaagaggaaagtcactcttgtttaagacctctgcaggggtcaatatgtgcactctcattgcgatggatttgggagagttatgtgaggacacaatgacctacaaatgccctcggatcactgaggcggaaccagatgacgttgactgctggtgcaatgccacagacacatgggtgacctatgggacgtgttctcaaaccggcgaacaccgacgagacaaacgttccgtggcactggccccacatgtgggacttggtctagaaacaagaaccgaaacatggatgtcctctgaaggcgcctggaaacaaatacaaaaagtggagacttgggctttgagacacccaggattcacggtgatagccctttttttagcacatgccataggaacatccattactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactatgcattgaagctaaaatatcaaacaccaccaccgattcaagatgtccaacacaaggagaggctacactggtggaagaacaagacgcgaactttgtgtgtcgacgaacgtttgtggacagaggctggggtaatggctgcggactatttggaaaaggaagcctattgacgtgtgccaagtttaagtgtgtgacaaaactagaaggaaagatagttcaatatgaaaacttaaaatattcagtgatagtcactgtccacactggggaccaacaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagacttgctggttacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggagcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggggttctgttcagcggtgtatcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggcaccacagttgttgtggatgaacattgtggaaatcgaggtccatctctcagaactacaacagtcacaggaaagataatccatgaatggtgttgcagatcctgcacgctaccccccttacggttcagaggagaagacggatgttggtatggcatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactagcatccagagaagttcttcttctcacgattggattaagcctggtggcatccgtggagctaccaaattctttggaggagctaggggatggacttgcaatgggtatcatgatgttaaaattattgactgaatttcagccacaccacttatggaccaccttactgtctttgacatttatcaaaacaactctttcattggattatgcatggaagacaacggctatggtactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtatcctgggaagaagaagcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctatagaatcttgcaaagaggactgttgggcaggtcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaaggacctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggagccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctggctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggaccctctatgcagtagccacaacagttatcactcccatgatgagacacacaattgaaaatacaacggcaaacatttccttgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacctggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctctgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctgtcccaatggcgacctatggatggaacctagtaaagctacactctggaaaagatgtattttttatgccacctgagaaatgtgacacccttctgtgtgatattggtgagtcctctccgaatccaactatagaagaaggtagaacgttacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagggtgtttaaagagaaagttgacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtatatgtggctgggagcacgttttctggagttcgaagcccttggcttcatgaatgaagatcactggtttagtagagagaattcactcagtggagtggaaggagaaggactgcacaaacttggatacatactcagagacatatcaaagattccggggggaaatatgtatgcagatgatacagccggatgggatacaagaataacagaggatgatcttcagaatgaggctaaaatcactgacatcatggagcctgaacatgctctattggctacgtcaatttttaagctgacttaccaaaataaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgtgtagtgaaaccaattgatgacaggttcgcaacagccttaatagctctgaatgacatgggaaaagtaagaaaagacataccgcagtgggaaccttcaaaaggatggaatgattggcagcaagtgcctttctgttcacaccattttcaccagttgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagcagtcccaattgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaagagggaagaccaatggtgtggatccctgataggcttgacagcgagggccacctgggccaccaacatacaagtagccataaaccaagtgagaaggcttatcgggaatgagaattatctagattacatgacatcaatgaagagattcaagaatgagagtgatcccgaaggggcactctggtaa

SEQ ID NO: 6 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaagggattgctttcaggccaaggacccatgaaattggtgatggctttcatagcatttctaagatttctagccatacccccaacagcaggaattttggctagatggagctcattcaagaagaatggagcgatcaaagtgttacggggtttcaaaaaagagatctcaagcatgttgaacataatgaacaggaggaaaagatccgtgaccatgctcctcatgctgctgcccacagccctggcgttccatttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacacccaggattcacggtgatagccctttttttagcacatgccataggaacatccatcactcagaaagggatcattttcattctgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctattgacgtgtgccaagttcaagtgtgtgacaaaactagaaggaaagatagttcaatatgaaaacttaaaatattcagtgatagtcaccgtccacactggggatcagcaccaggtgggaaacgagactacagaacatggaacaattgcaaccataacacctcaagctcctacgtcggaaatacagttgactgactacggaaccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaggggacgtcatatgtgatgtgcacaggctcatttaagctagagaaggaagtggctgagacccagcatgggactgttctagtgcaggtcaaatacgaaggaacagatgcgccatgcaagatccccttttcgacccaagatgagaaaggggtgacccagaatggtagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgcgtaatcaactggaagggcagagaactcaaatgtggaagtggcatttttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctaatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatctcacactctatggagtaatggagttttggaaagtgaaatgataatcccaaagatgtatggaggaccaatatctcagcacaactacagaccagggtatttcacacaaacagcagggccatggcatctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggactcgcaatgggtatcatgatgttaaaattattgactgaatttcagccacaccagttatggaccaccttactgtctctgacatttatcaaaacaactctttcattggattacgcatggaagacaacggctatggtactgtcaatcgtatctctctttcctttatgcctgtctacgacctctcaaaaaacaacatggcttccggtgctgttaggatcttttggatgcaaaccattaaccatgtttctcataacagaatacgaaatctggggaagaaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctatagaatcttgcaaagaggactgttgggcaggtcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagccaaagcatcacaggaagagcctctaccagagattgaggacgaggtgtttaagaaaagaaacttaacaataatggaccttcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccatgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcaggaaaacctttgacactgagtaccagaaaacaaaaaacaatgactgggactatgttgtcacaacagacatttctgaaatgggggcaaatttccgggctgacagggtaatagacccaaggcggtgcttgaaaccggtaatactaaaagatggtccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggacaacttggtcatgttgcataattccgaacaaggaggaaaagcctatagacatgctatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacttacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcgttaatgaaatctttaggaggaggtaggagaggtacgggagctcaaggggaaacattaggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcgagaggagcagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgagattgctcacaaaaccatgggatgttatccccatggtcacacaaatagctatgactgataccacaccctttggacaacagagagtgtttaaagagaaggttgacacgcgcacaccaagagcaaaacgaggcacagcacaaattatggaagtgacagccaagtggttatggggtttcctttccagaaacaaaaaacccagaatctgcacaagagaggagttcacaaggaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgtcgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 7 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaagggattgctttcaggccaaggacccatgaaattggtgatggctttcatagcatttctaagatttctagccatacccccaacagcaggaattttggctagatggagctcattcaagaagaatggagcgatcaaagtgttacggggtttcaaaaaagagatctcaagcatgttgaacataatgaacaggaggaaaagatccgtgaccatgctcctcatgctgctgcccacagccctggcgttccatttgaccacacgagggggagagccacacatgatagttagtaagcaggaaagaggaaagtcactcttgttcaagacctctgcaggtgtcaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctattgacgtgtgccaagttcaagtgtgtgacaaaactagaaggaaagatagttcaatatgaaaacttaaaatattcagtgatagtcaccgtccacactggggatcagcaccaggtgggaaacgagactacagaacatggaacaattgcaaccataacacctcaagctcctacgtcggaaatacagttgactgactacggagccctcacattggactgctcacccagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaggggacgtcatatgtgatgtgcacaggctcatttaagctagagaaggaagtggctgagacccagcatgggactgttctagtgcaggtcaaatacgaaggaacagatgcgccatgcaagatccccttttcgacccaagatgagaaaggggtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctaatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgataatcccaaagatgtatggaggaccaatatctcagcacaactacagaccagggtatttcacacaaacagcagggccatggcatctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtagacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactttctctgacatttatcaaaacaactctttcattggattacgcatggaagacaacggctacggtactgtcaatcgtatctctctttcctttatgcctgtctacgacctctcaaaaaacaacatggcttccggtgctgttaggatcttttggatgcaaaccattaaccatgtttctcataacagaaaacgaaatctggggaagaaaaagttggcccctcaatgaaggaattatggctattggaatagtcagcattctactaagttcactcctcaaaaatgatgtgccgttggccggcccactaatagctggaggcatgctaatagcgtgttatgtcatatccggaagctcagccgatctatcattggagaaagcggctgaggtatcctgggaagaagaagcagaacactccggtacctcacacaacatattagtagaggttcaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgtttaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcaggaaaacctttgacactgagtaccagaaaacaaaaaacaatgactgggactatgttgtcacaacagacatttctgaaatgggggcaaatttccgggctgacagggtaatagacccaaggcggtgtttgaaaccggtaatactaaaagatggtccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaagtgacctaatattggaaatagggaaacttccacaacatttgacgctaagagcccagaatgctctggataacttggtcatgttgcataattccgaacaaggaggaaaagcctatagacatgctatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacttacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttataccacctgagaaatgtgacacccttctgtgtgatattggtgagtcctctccaaatccaactatagaagaaggtagaacgctacgtgttctaaagatggtggaaccatggctcagaggcaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgagattgctcacaaaaccatgggatgttatccccatggtcacacaaatagctatgactgataccacaccctttggacaacagagagtgtttaaagagaaggttgacacgcgcacaccaagagcaaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgtcgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtga

SEQ ID NO: 8 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcgatcaaagtgttgcggggtttcaaaaaagagatctcaagcatgttgaacataatgaacaggaggaaaagatccgtgaccatgctcctcatgctgctgcccacagccctggcgttccatttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacacccaggattcacggtgatagctctttttttagcacatgccataggaacatccatcactcagaaagggatcattttcattctgctgatgctggtaacaccatcaatggccatgcgatgcgtgggaataggcaacagagacttcgtcgaaggactgtcaggagcaacgtgggtagacgtggtattggagcatggaagctgcgtcaccactatggcaaaaaataaaccaacattggacattgaactcttgaagacggaggtcacgaaccctgccgtcttgcgcaaattgtgcattgaagccaaaatatcaaacaccaccaccgattcaagatgtccaacacaaggagaggccacactggtggaagaacaagacgcgaactttgtgtgtcgccgaacgtttgtggacagaggctggggtaatggctgcggattattcggaaaaggaagcctattgacgtgtgccaagtttaagtgtgtgacaaaactagaaggaaagatagttcaatatgaaaacttgaaatattcagtgatagtcactgtccacactggggatcagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagttgtactgggatcacaggaaggagcaatgcacaccgcgttgactggggcgacagaaatccagacgtcaggaacgacaacaatctttgcagggcacctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagatgcgccatgcaagatcccctttttgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctctgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgtagttggcatggttacactgtacctaggagtcatggttcaagcggactcgggatgtgtaatcaactggaagggcagagaactcaaatgtggaagtggcatctttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctaatggaattttggcccaaggaaaaaaaatgattaggccacaacccatggaacacaaatactcatggaaaagctggggaaaagctaaaatcataggagcagacatacaaaacaccaccttcatcatcgacggcccagatactccagaatgccccgatgagcaaagagcgtggaacatttgggaagttgaggactatgggtttggaattttcacgacaaacatatggctgaaattgcgtgactcccacactcaaatgtgtgaccaccggctaatgtcagctgccatcaaggacagcaaggcagtccatgctgacatggggtactggatagaaagtgaaaagaacgagacctggaagctagcgagagcctccttcatagaagtcaagacatgcatctggccgaaatcccacactctatggagtaatggagttttggaaagtgaaatgataatcccaaagatgtatggaggaccaatatctcagcacaactacagaccagggtatttcacacaaacagcagggccatggcatctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgcttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacatcagttatggaccaccttactgtctctgacatttatcaaaacaactctttcattggattacgcatggaagacaacggctatggtgctgtcaatcgtatctctctttcctttatgcctgtctacgacctctcaaaaaacaacatggcttccggtgctgttaggatcttttggatgcaaaccattaaccatgtttctcataacagaaaacgaaatctggggaagaaaaagttggcccctcaatgaaggaattatggctgttggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgacgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtgcagacaacgccgggtaccttcaagactcctgaaggcgaagttggagccatagctctagattttaaacccggcacatctggatctcccatcgtaaacagagagggaaaaatagtaggtctttatggaaatggagtggtgacaacaagtggaacctacgtcagtgccatagcccaagctaaagcatcacaggaagggcctctaccagagattgaggacgaggtgttcaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaataccaataagatatcagacaacagcagtgaagagtgagcacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaatcagtctggtttgttccaagcattaaatcaggaaatgacattgctaactgcttaagaaagaacggaaaacgggtaatccaattgagcaggaaaacctttgacaccgagtaccagaaaaccaaaaacaatgactgggactatgttgtcacaacagacatttccgaaatgggggcaaatttccgggctgacagggtaatagacccaaggcggtgcttgaaaccggtaatactaaaagatggtccagagcgtgtcattctagccggaccgatgccagtgactgtggccagtgcagcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgccatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattgttggaaaccacaaagaaagacctggggattggccatgtagccgccgaaaaccaccaacatgctacaatgctggacgtagacctacgtccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttacaatagacttggatcctgtggtttatgatgcaaaatttgaaaaacagctaggccaaataatgttactgatactttgtacatcacagatcctcttaatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactaggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtccagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggcgggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgaggttgctcacaaaaccatgggatgttatccccatggtcacacaaatagctatgactgataccacaccctttggacaacagagagtgtttaaagagaaggttgacacgcgcacaccaagagcgaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggttcagtagagagaattcactcagtggagtggaaggagaaggactgcacaaacttggatacatactccgagacatatcaaagattccggggggaaatatgtatgcagatgatacagccggatgggacacaagaataacagaggatgatcttcggaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccctcaaaaggatggaatgattggcagcaagtgcctttctgttcacaccatttccaccagctgatcatgaaggatgggagggaaatagtggtgccgtgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacatagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 9 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcgggccaaggacccatgaaattggtgatggcttttatagcatttctaagatttctagccatacccccaacagcaggaattttggctagatggagctcattcaagaagaatggagcgatcaaagtgttacggggtttcaaaaaagagatctcaagcatgttgaatattatgaacaggaggaaaaaatctgtgaccatgctcctcatgctgctgcccacagccctggcgttccatttgaccacacgagggggagagccacacatgatagttagtaagcaggaaagaggaaagtcactgttgtttaagacctctgcaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgatcgctctttttttagcacatgccataggaacatccatcactcagaaagggatcattttcattttgctgatgctagtaacaccatcaatggccatgcgatgtgtgggaataggcaacagggacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaagctagaaggaaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaagcaggaagtagtcgtactgggatcacaggaaggagcaatgcacactgcattgactggggcgacagaaatccagacgtcaggaacgacaacgatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacatcgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtaggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaaaggcagagaactcaaatgtggaagtggtatttttgtcaccaatgaagtccacacttggacagagcaatacaaattccaggctgactccccaaaaagactgtcagcagccatagggaaggcatgggaagagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccgaaatctcacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggcccatctctcaggactacaacagtcacaggaaagataatccatgaatggtgctgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacattctggtacctcacacaacatattagtagaggtccaagatgatggaactatgaaaataaaggatgaagagagggatgacacactcaccatactcctcaaagcaactttgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaagtcccaagtaggagtgggagttttccaggacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagctatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcacccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccatgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaattcaggctacgactggatcactgattttccaggtaaaacagtctggtttgttccaagcatcaagtcaggaaatgacattgctaactgtttaagaaagaacggaaaacgggtgatccaattgagcagaaaaacctttgacactgagtaccagaaaacaagaaacaatgactgggactatgtcgtcacaacagacatttccgaaatgggggcaaatttccgggccgacagggtaatagacccaaggcggtgcttgaaaccagtaatactaaaagatggtccagagcgtgtcattctagccggaccgatgccagtgactgtggccagtgctgcccagagaagaggaagaatcggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggagggaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgttgctcattccagagccagacagacagcgcactccacaggacaaccagctagcatacgtggtgataggtttgttattcatgatactgacagtggcagccaatgagatgggattattagaaaccacaaagaaagacctggggattggccatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggagctcaaggagaaacactgggagagaaatggaaaagacagttaaaccaactgagcaagtcagaattcaacacctacaaaaggagtgggattatggaggtggacagatccggagccaaagaaggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatactattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagattccggggggaaacatgtatgcagatgacacagccggatgggacacaagaataacagaggatgatcttcagaatgaggccaaaatcactgacatcatggagcctgaacacgctctattagctacgtcaatttttaagctgacctaccaaaacaaggtggtaagggtgcaaagaccagcaaaaaatggaaccgtgatggatgttatatccagacgagaccagagaggaagtgggcaggtcggaacctatggcctaaatactttcaccaatatggaggtccaactaataagacaaatggagtctgaaggaattattttacccagcgaattggaaacccccaatctagctgagagagttcttaactggttggaaaaacatggtactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagctgtcccagttgactgggttccaaccagccgcacaacctggtcaatccatgctcaccatcaatggatgacaacagaagatatgttatcagtgtggaatagggtttggatagaggaaaacccatggatggaggataaaactcatgtatccagttgggaagaagttccatacttagggaaaagggaagatcaatggtgtggatccctgataggcttgacagcgagggccacctgggccactaacatacaagttgccataaaccaagtgagaaggctcatcgggaatgagaattatctagattacatgacatcaatgaagagattcaagaatgagagtgatcccgaaggggcactctggtaa

SEQ ID NO: 10 - DNA, 10179 bp, Dengue virus
atgaacaaccaacggaaaaagacgggtcgaccgtctttcaatatgctgaaacgcgcgcgaaaccgcgtgtcaactggttcacagttggcgaagagattctcaaaaggattgctttcgggccaaggacccatgaaattggtgatggcttttatagcatttctaagatttctagccataccccctacagcaggaattttggctagatggagctcattcaagaagaatggagcgatcaaagtgttacggggtttcaaaaaagagatctcaagcatgttgaatattatgaacaggaggaaaaaatctgtgaccatgctcctcatgctgctgcccacagccctggcgttccatttgaccacacgagggggagagccacacatgatagttagtaagcaggaaagaggaaagtcactgttgtttaagacctctgcaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagagacttcgtggaaggactgtcaggagcaacgtgggtggatgtggtactggagcatggaagttgcgtcaccaccatggcaaaagataaaccaacattggacattcaactcttgaagacggaggtcacaaaccctgccgtcctgcgtaaactgtgcattgaagctaaaatatcaaacaccaccaccgattcaagatgtccaacacaaggggaagccacactggtggaagaacaagacgcgaacttcgtgtgtcgacgaacgtttgtggacagaggctggggcaatggctgtgggcttttcggaaaaggtagcctaataacgtgtgctaagttcaagtgtgtgacaaaactggaaggaaagatagttcaatatgagaacttgaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcattgactggggcgacagaaatccagacgtcaggaacgacaacgatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacatcgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaaaggcagagaactcaaatgtggaagtggtatttttgtcaccaatgaagtccacacttggacagagcaatacaaattccaggctgactccccaaaaagactgtcagcagccatagggaaggcatgggaagagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaggactatgggtttggaattttcacgacaaacatatggctgaaattgcgtgactcccacactcaaatgtgtgaccaccggctaatgtccgctgccatcaaggacagcaaggcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggcccatctctcagaactacaacagtcacaggaaagataatccatgaatggtgctgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacattctggtacctcacacaacatattagtagaggtccaagatgatggaactatgaaaataaaggatgaagagagggatgacacactcaccatactcctcaaagcaactttgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaagtcccaagtaggagtgggagttttccaggacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagctatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcacccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccatgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaattcaggctacgactggatcactgattttccaggtaaaacagtctggtttgttccaagcatcaagtcaggaaatgacattgctaactgtttaagaaagaacggaaaacgggtgatccaattgagcagaaaaacctttgacactgagtaccagaaaacaagaaacaatgactgggactatgtcgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaatcggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaagaaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggagggaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattagaaaccacaaagaaagacctggggattggccatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagaaggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatactattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggccaaaatcactgacatcatggagcctgaacacgctctattagctacgtcaatttttaagctgacctaccaaaacaaggtggtaagggtgcaaagaccagcaaaaaatggaaccgtgatggatgttatatccagacgagaccagagaggaagtgggcaggtcggaacctatggcctaaatactttcaccaatatggaggtccaactaataagacaaatggagtctgaaggaattattttacccagcgaattggaaacccccaatctagctgagagagttcttaactggttggaaaaacatggtactgaaaggctgaaaagaatggcaattagcggagatgattgtgtggtgaaaccagttgatgacaggtttgcaacagccttaatagctctgaatgacatgggaaaagtaagaaaagacataccgcagtgggaaccctcaaaaggatggaatgactggcagcaagtgcctttctgttcacaccatttccaccagctgatcatgaaggatgggagagaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggttccaaccagccgcacaacctggtcaatccatgctcaccatcaatggatgacaacagaagatatgttatcagtgtggaatagggtttggatagaggaaaacccatggatggaggataaaactcatgtatccagctgggaagaagtcccatacttagggaaaagggaagatcaatggtgtggatccctgataggcttgacagcgagggccacttgggccactaacatacaagttgccataaaccaagtgagaaggctcatcggaaatgagaattatctagattacatgacatcaatgaagagattcaagaatgagagtgatcccgaaggggcactctggtaa

SEQ ID NO: 11 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcgatcaaagtgttacggggtttcaaaaaagagatctcaagcatgttgaacataatgaacaggaggaaaagatccgtgaccatgctcctcatgctgctgcccacagccctggcgttccatttgaccacacgagggggagagccacacatgatagttagtaagcaggaaagaggaaagtcactcttgttcaagacctctggaggtgttaatatgtgcactctcattgcgatggatttgggagaattatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctattgacgtgtgccaagttcaagtgtgtgacaaaactagaaggaaagatagttcaatatgaaaacttaaaatattcagtgatagtcaccgtccacactggggatcagcaccaggtgggaaacgagactacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagatgcgccatgcaagatcccctttttgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgtttagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgcgtaatcaactggaagggcagagaactcaaatgtggaagtggcatttttgtcactaatgaagtccacacttggacagagcaatacaaattccaggccgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaatttacagtggttgtaggaaatgctaatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgataatcccaaagatgtatggaggaccaatatctcagcacaactacagaccagggtatttcacacaaacagcagggccatggcatctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtggaaagatgctcatgactggaacactggctgttttcctccttcttataatgggacagctgacatggaatgatctgattaggttatgcatcatggttggagctaatgcttcagacaagatggggatgggaacaacgtacctagccttgatggctactctcaaaatgagaccaatgttcgctgttgggctattatttcgcagactaacatccagagaagttcttcttctcacgattggattaagcctggtggcatccgtggagctaccaaattctttggaggagctaggggatggacttgcaatgggcatcatgatgttaaaattattgactgaatttcagccacaccagttatggaccaccttactgtctctgacatttatcaaaacaactctttcattggattacgcatggaagacaacggctatggtactgtcaatcgtatctctttttcctttatgcctgtctacgacctctcaaaaaacaacatggcttccggtgctgttaggatcttttggatgcaaaccattaaccatgtttctcataacagaaaacgaaatctggggaagaaaaagttggcccctcaatgaaggaattatggctattggaatagtcagcattctactaagttcactcctcaaaaatgatgtgccgctggccggcccactaatagctggaggcatgctaatagcatgttatgtcatatccggaagctcagccgatctatcattggagaaagcggctgaggtatcctgggaagaagaagcagaacactccggtacctcacacaacatattagtagaggtccaagatgatggaactatgaaaataaaagatgaagaaagggatgacacactcactatactccttaaagccactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgtttaagaaaagaaacttaacaataatggacctccatccaggatcaggaaaaacaagaagatatcttccagccatagtccgtgaggccataagaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgatcattatggatgaagcacattttaccgatccagccagcatagcggccagagggtacatctcaacccgagtgggtatgggtgaagcagctgcgatctttatgacagccactcccccaggatcggtggaggcctttccacagagtaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgactgggactatgttgtcacaacagacatttctgaaatgggggcaaatttccgggctgacagggtaatagacccaaggcggtgcttgaaaccggtaatactaaaagatggtccagagcgtgtcattctagccggaccgatgccagtgactgtggccagtgctgcccaaaggagaggaagaattggaaggaaccagaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaagagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgctatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacttacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtggacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtttggccttctcattaatgaaatctttaggaggaggtaggagaggtacgggagctcaaggggaaacattaggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaaaggatacacaaaaggaggacctggacatgaggaacccatcccaatggcgacctatggatggaacctagtgaagctgcactctggaaaagatgttttttttatgccacctgagaaatgtgacacccttctgtgtgatattggtgagtcctctccgaacccaactatagaagaaggtagaacactacgtgttctaaagatggtggaaccatggctcagaggcaaccaattctgcataaaaatcctaaatccttacatgccaagtgtggtagaaactctggagcaaatgcaaaggaaacatggagggatgctagtgagaaacccactctcaagaaattccacccatgaaatgtactgggtttcatgcggaacaggaaacattgtgtcggcagtgaacatgacatccagaatgttactgaatcgattcacaatggcgcataggaagccaacatatgaaagagatgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggtcaagccatcaggatcagcctcatctatggtgaatggcgtggtgagattgctcacaaaaccatgggatgttatccccatggtcacacaaatagctatgactgataccacacccttcggacaacagagagtgtttaaagagaaagttgacacgcgcacaccaagagcaaaacgaggcacagcacaaattatggagatgacagcaaaatggttatggggtttcctttccagaaacaaaaaacccagaatctgcacaagagaggagttcataaggaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcagcgtttctggagttcgaggctcttggtttcatgaatgaagatcactggtttagtagagagaattcactcagtggagtggaaggagaaggactgcacaaacttggatacatactcagagacatatcaaagattcccgggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgcgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttaattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgaaagtgatcccgaaggggcactctggtaa

SEQ ID NO: 12 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaagggattgctttcaggccaaggacccatgaaattggtgatggctttcatagcatttctaagatttctagccatacccccaacagcaggaattttggctagatggagctcattcaagaagaatggagcgatcaaagtgttacggggtttcaaaaaagagatctcaagcatgttgaacataatgaacaggaggaaaagatccgtgaccatgctcctcatgctgctgcccacagccctggctttccatttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgttggtgcaatgccacagacacatgggtgacctatgggacgtgttctcaaaccggcgaacaccgacgagacaaacgttccgtggcactggccccacacgtgggactcggtctagaaacaagaaccgaaacatggatgtcctctgaaggcgcctggaaacaaatacaaaaagtggagacttgggctttgagacacccaggattcacggtgatagccctttttttagcacatgccataggaacatccatcactcagaaagggatcattttcattctgctgatgctggtgacaccatcaatggccatgcgatgcgtgggaataggcaacagagacttcgttgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagtctattgacgtgtgccaagttcaagtgtgtgacaaaactagaaggaaagatagttcaatatgaaaacttaaaatattcagtgatagtcaccgtccacactggggatcagcaccaggtgggaaacgagactacagaacatggaacaattgcaaccataacacctcaagctcctacgtcggaaatacagttgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacttgaaatgcagactaaaaatggataaactgactttaaaggggacgtcatatgtgatgtgcacaggctcatttaagctagagaaggaagtggctgagacccagcatgggactgttctagtgcaggtcaaatacgaaggaacagatgcgccatgcaagatccccttttcgacccaagatgagaaaggggtgacccagaatgggagattgataacagccaatcccatagttactgacaaagaaaaaccagtcaacatcgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatccgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaagctgactccccaaaaagactgtcagcagccattggaagggcatgggaggagggcgtgtgtggaattcgatcagccacgcgtcttgagaacatcatgtggaagcaaatatcaaatgaattgaaccacattctacttgaaaatgacataaaattcacagtggttgtaggaaatgctaatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgataatcccaaagatgtacggaggaccaatatctcagcacaactacagaccagggtatttcacacaaacagcagggccatggcacctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactgtctctgacatttatcaaaacaactctttcattggattacgcatggaagacaacggctatggtactgtcaatcgtatctctctttcctttatgcctgtctacgacctctcaaaaaacaacatggcttccggtgctgttaggatcttttggatgcaaaccattaaccatgtttcttataacagaaaacgaaatctggggaagaaaaagttggcccctcaatgaaggaattatggctattggaatagtcagcattctactaagttcactcctcaaaaatgatgtgccgttggccggcccactcatagctggaggcatgctaatagcatgttatgtcatatccggaagctcagccgatctatcattggagaaagcggctgaggtatcctgggaagaagaagcagaacactccggtacctcacacaacatattagtagaggtccaagatgatggaactatgaaaataaaagatgaagaaagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctacagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtaaaaaaggacttgatctcatatggaggaggttggaggtttcaaggatcatggaacacgggagaagaagtgcaggtgatagctgttgaaccagggaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgtttaagaaaagaaacttaacaataatggacctccatccaggatcaggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgtctaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggcccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatttaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgctatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattcctgagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatactggacgtagacctacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcctgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaagtagccaacctagatatcattggccagaggatagagaatataaaaaatgaacacaagtcaacatggcattatgatgaggacaatccatacaaaacatgggcctatcatggatcatatgaggttaagccatcaggatcagcctcatctatggtgaatggagtggtgagattgctcacaaaaccatgggatgtcatccccatggtcacacaaatagctatgactgataccacaccctttggacaacagagagtgtttaaagagaaggttgacacgcgcacaccaagagcaaaacgaggcacagcacaaattatggaggtgacagccaagtggttatggggattcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcacaaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgactgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgctggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtga

SEQ ID NO: 13 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaattggtgatggcttttatagcattcctaagatttctagccatacctccaacagcaggaattttggctagatggggctcattcaagaagaatggagcgatcaaagtgttacggggtttcaagaaagaaatctcaaacatgttgaacataatgaacaggaggaaaagatctgtgaccatgctcctcatgctgctgcccacagccctggcgttccatctgaccacccgagggggagagccgcacatgatagttagcaagcaggaaagaggaaaatcacttttgtttaagacctctgcaggtgtcaacatgtgcacccttattgcaatggatttgggagagttatgtgaggacacaatgacctacaaatgcccccggatcactgagacggaaccagatgacgttgactgttggtgcaatgccacggagacatgggtgacctatggaacatgttctcaaactggtgaacaccgacgagacaaacgttccgtcgcactggcaccacacgtagggcttggtctagaaacaagaaccgaaacgtggatgtcctctgaaggcgcttggaaacaaatacaaaaagtggagacctgggttctgagacacccaggattcacggtgatagccctttttctagcacatgccataggaacatccatcacccagaaagggatcatttttattttgctgatgctggtaactccatccatggccatgcggtgcgtgggaataggcaacagagacttcgtggaaggactgtcaggagctacgtgggtggatgtggtactggagcatggaagttgcgtcactaccatggcaaaagacaaaccaacactggacattgaactcttgaagacggaggtcacaaaccctgccgtcctgcgcaaactgtgcattgaagctaaaatatcaaacaccaccaccgattcgagatgtccaacacaaggagaagccacgctggtggaagaacaggacacgaactttgtgtgtcgacgaacgttcgtggacagaggctggggcaatggttgtgggctattcggaaaaggtagcttaataacgtgtgctaagtttaagtgtgtgacaaaactggaaggaaagatagtccaatatgaaaacttaaaatattcagtgatagtcaccgtacacactggagaccagcaccaagttggaaatgagaccacagaacatggaacaactgcaaccataacacctcaagctcccacgtcggaaatacagctgacagactacggagctctaacattggattgttcacctagaacagggctagactttaatgagatggtgttgttgacaatggaaaaaaaatcatggctcgtccacaaacaatggtttctagacttaccactgccttggacctcgggggcttcaacatcccaagagacttggaatagacaagacttgctggtcacatttaagacagctcatgcaaaaaagcaggaagtagtcgtactaggatcacaagaaggagcaatgcacactgcgttgactggagcgacagaaatccaaacgtctggaacgacaacaatttttgcaggacacctgaaatgcagactaaaaatggataaactgactttaaaagggatgtcatatgtaatgtgcacagggtcattcaagttagagaaggaagtggctgagacccagcatggaactgttctagtgcaggttaaatacgaaggaacagatgcaccatgcaagatccccttctcgtcccaagatgagaagggagtaacccagaatgggagattgataacagccaaccccatagtcactgacaaagaaaaaccagtcaacattgaagcggagccaccttttggtgagagctacattgtggtaggagcaggtgaaaaagctttgaaactaagctggttcaagaagggaagcagtatagggaaaatgtttgaagcaactgcccgtggagcacgaaggatggccatcctgggagatactgcatgggacttcggttctataggaggggtgttcacgtctgtgggaaaactgatacaccagatttttgggactgcgtatggagttttgttcagcggtgtttcttggaccatgaagataggaatagggattctgctgacatggctaggattaaactcaaggagcacgtccctttcaatgacgtgtatcgcagttggcatggtcacactgtacctaggagtcatggttcaggcggactcgggatgtgtaatcaactggaaaggcagagaactcaaatgtggaagcggcatttttgtcaccaatgaagtccacacctggacagagcaatataaattccaggccgactcccctaagagactatcagcggccattgggaaggcatgggaggagggtgtgtgtggaattcgatcagccactcgtctcgagaacatcatgtggaagcaaatatcaaatgaattaaaccacatcttacttgaaaatgacatgaaatttacagtggtcgtaggagacgttagtggaatcttggcccaaggaaagaaaatgattaggccacaacccatggaacacaaatactcgtggaaaagctggggaaaagccaaaatcataggagcagatgtacagaataccaccttcatcatcgacggcccaaacaccccagaatgccctgataaccaaagagcatggaacatttgggaagttgaagactatggatttggaattttcacgacaaacatatggttgaaattgcgtgactcctacactcaagtgtgtgaccaccggctaatgtcagctgccatcaaggatagcaaagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagatatatggaggaccaatatctcagcacaactacagaccaggatatttcacacaaacagcagggccgtggcacttgggcaagttagaactagattttgatttatgtgaaggtaccactgttgttgtggatgaacattgtggaaatcgaggaccatctcttagaaccacaacagtcacaggaaagacaatccatgaatggtgctgtagatcttgcacgttaccccccctacgtttcaaaggagaagacgggtgctggtacggcatggaaatcagaccagtcaaggagaaggaagagaacctagttaagtcaatggtctctgcagggtcaggagaagtggacagtttttcactaggactgctatgcatatcaataatgatcgaagaggtaatgagatccagatggagcagaaaaatgctgatgactggaacattggctgtgttcctccttctcacaatgggacaattgacatggaatgatctgatcaggctatgtatcatggttggagccaacgcttcagacaagatggggatgggaacaacgtacctagctttgatggccactttcagaatgagaccaatgttcgcagtcgggctactgtttcgcagattaacatctagagaagttcttcttcttacagttggattgagtctggtggcatctgtagaactaccaaattccttagaggagctaggggatggacttgcaatgggcatcatgatgttgaaattactgactgattttcagtcacatcagctatgggctaccttgctgtctttaacatttgtcaaaacaactttttcattgcactatgcatggaagacaatggctatgatactgtcaattgtatctctcttccctttatgcctgtccacgacttctcaaaaaacaacatggcttccggtgttgctgggatctcttggatgcaaaccactaaccatgtttcttataacagaaaacaaaatctggggaaggaaaagctggcctctcaatgaaggaattatggctgttggaatagttagcattcttctaagttcacttctcaagaatgatgtgccactagctggcccactaatagctggaggcatgctaatagcatgttatgtcatatctggaagctcggccgatttatcactggagaaagcggctgaggtctcctgggaagaagaagcagaacactctggtgcctcacacaacatactagtggaggtccaagatgatggaaccatgaagataaaggatgaagagagagatgacacactcaccattctcctcaaagcaactctgctagcaatctcaggggtatacccaatgtcaataccggcgaccctctttgtgtggtatttttggcagaaaaagaaacagagatcaggagtgctatgggacacacccagccctccagaagtggaaagagcagtccttgatgatggcatttatagaattctccaaagaggattgttgggcaggtctcaagtaggagtaggagtttttcaagaaggcgtgttccacacaatgtggcacgtcaccaggggagctgtcctcatgtaccaagggaagagactggaaccaagttgggccagtgtcaaaaaagacttgatctcatatggaggaggttggaggtttcaaggatcctggaacgcgggagaagaagtgcaggtgattgctgttgaaccggggaagaaccccaaaaatgtacagacagcgccgggtaccttcaagacccctgaaggcgaagttggagccatagctctagactttaaacccggcacatctggatctcctatcgtgaacagagagggaaaaatagtaggtctttatggaaatggagtggtgacaacaagtggtacctacgtcagtgccatagctcaagctaaagcatcacaagaagggcctctaccagagattgaggacgaggtgtttaggaaaagaaacttaacaataatggacctacatccaggatcgggaaaaacaagaagataccttccagccatagtccgtgaggccataaaaagaaagctgcgcacgctagtcttagctcccacaagagttgtcgcttctgaaatggcagaggcgctcaagggaatgccaataaggtatcagacaacagcagtgaagagtgaacacacgggaaaggagatagttgaccttatgtgtcacgccactttcactatgcgtctcctgtctcctgtgagagttcccaattataatatgattatcatggatgaagcacatttcaccgatccagccagcatagcagccagagggtatatctcaacccgagtgggtatgggtgaagcagctgcgattttcatgacagccactccccccggatcggtggaggcctttccacagagcaatgcagttatccaagatgaggaaagagacattcctgaaagatcatggaactcaggctatgactggatcactgatttcccaggtaaaacagtctggtttgttccaagcatcaaatcaggaaatgacattgccaactgtttaagaaagaatgggaaacgggtggtccaattgagcagaaaaacttttgacactgagtaccagaaaacaaaaaataacgactgggactatgttgtcacaacagacatatccgaaatgggagcaaacttccgagccgacagggtaatagacccgaggcggtgcctgaaaccggtaatactaaaagatggcccagagcgtgtcattctagccggaccgatgccagtgactgtggctagcgccgcccagaggagaggaagaattggaaggaaccaaaataaggaaggcgatcagtatatttacatgggacagcctctaaaaaatgatgaggaccacgcccattggacagaagcaaaaatgctccttgacaacataaacacaccagaagggattatcccagccctctttgagccggagagagaaaagagtgcagcaatagacggggaatacagactacggggtgaagcgaggaaaacgttcgtggagctcatgagaagaggagatctacctgtctggctatcctacaaagttgcctcagaaggcttccagtactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaacgccttggacaatctggttatgttgcacaactctgaacaaggaggaaaagcctatagacacgccatggaagaactaccagacaccatagaaacgttaatgctcctagctttgatagctgtgctgactggtggagtgacgttgttcttcctatcaggaaggggtctaggaaaaacatccattggcctactctgcgtgattgcctcaagtgcactgttatggatggccagtgtggaaccccattggatagcggcctctatcatactggagttctttctgatggtgttgcttattccagagccggacagacagcgcactccacaagacaaccagctagcatacgtggtgataggtctgttattcatgatattgacagtggcagccaatgagatgggattactggaaaccacaaagaaggacctggggattggtcatgcagctgctgaaaaccaccatcatgctgcaatgctggacgtagacctacatccagcttcagcctggactctctatgcagtggccacaacaattatcactcccatgatgagacacacaattgaaaacacaacggcaaatatttccctgacagctattgcaaaccaggcagctatattgatgggacttgacaagggatggccaatatcaaagatggacataggagttccacttctcgccttggggtgctattctcaggtgaacccgctgacgctgacagcggcggtattgatgctagcggctcattatgccataattggacccggactgcaagcaaaagctactagagaagctcaaaaaaggacagcagccggaataatgaaaaacccaactgtcgacgggatcgttgcaatagatttggaccctgtggtttacgatgcaaaatttgaaaaacagctaggccaaataatgttgttgatactttgcacatcacagatcctcctgatgcggaccacatgggccttgtgtgaatccatcacactagccactggacctctgactacgctttgggagggatctccaggaaaattctggaacaccacgatagcggtgtccatggcaaacatttttaggggaagttatctagcaggagcaggtctggccttttcattaatgaaatctctaggaggaggtaggagaggcacgggagcccaaggggaaacactgggagaaaaatggaaaagacagctaaaccaattgagcaagtcagaattcaacacttacaaaaggagtgggattatagaggtggatagatctgaagccaaagaggggttaaaaagaggagaaacgactaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacgaaaggaggacctggacatgaggaaccaatcccaatggcaacctatggatggaacctagtaaagctatactccgggaaagatgtattctttacaccacctgagaaatgtgacaccctcttgtgtgatattggtgagtcctctccgaacccaactatagaagaaggaagaacgttacgtgttctaaagatggtggaaccatggctcagaggaaaccaattttgcataaaaattctaaatccctatatgccgagtgtggtagaaactttggagcaaatgcaaagaaaacatggaggaatgctagtgcgaaatccactctcaagaaactccactcatgaaatgtactgggtttcatgtggaacaggaaacattgtgtcagcagtaaacatgacatctagaatgctgctaaatcgattcacaatggctcacaggaagccaacatatgaaagagacgtggacttaggcgctggaacaagacatgtggcagtagaaccagaggtggccaacctagatatcattggccagaggatagagaatataaaaaatgaacacaaatcaacatggcattatgatgaggacaatccatacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacagagggtgtttaaagagaaagttgacacgcgtacaccaaaagcgaaacgaggcacagcacaaattatggaggtgacagccaggtggttatggggttttctctctagaaacaaaaaacccagaatctgcacaagagaggagttcacaagaaaagtcaggtcaaacgcagctattggagcagtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaattaggagagttcggaaaggcaaaaggaagtcgcgcaatatggtacatgtggttgggagcgcgctttttagagtttgaagcccttggtttcatgaatgaagatcactggttcagcagagagaattcactcagtggagtggaaggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctattggccacgtcaatctttaagctaacctaccaaaacaaggtagtaagggtgcagagaccagcgaaaaatggaaccgtgatggatgtcatatccagacgtgaccagagaggaagtggacaggttggaacctatggcttaaacaccttcaccaacatggaggcccaactaataagacaaatggagtctgagggaatcttttcacccagcgaattggaaaccccaaatctagccgaaagagtcctcgactggttgaaaaaacatggcaccgagaggctgaaaagaatggcaatcagtggagatgactgtgtggtgaaaccaattgatgacagatttgcaacagccttaacagctttgaatgacatgggaaaggtaagaaaagacataccgcaatgggaaccttcaaaaggatggaatgattggcaacaagtgcctttctgttcacaccatttccaccagctgattatgaaggatgggagggagatagtggtgccatgccgcaaccaagatgaacttgtaggtagggccagagtatcacaaggcgccggatggagcttgagagaaactgcatgcctaggcaagtcatatgcacaaatgtggcagctgatgtacttccacaggagagacttgagattagcggctaatgctatctgttcagccgttccagttgattgggtcccaaccagccgtaccacctggtcgatccatgcccaccatcaatggatgacaacagaagacatgttgtcagtgtggaatagggtttggatagaggaaaacccatggatggaggacaagactcatgtgtccagttgggaagacgttccatacctaggaaaaagggaagatcaatggtgtggatccctaataggcttaacagcacgagccacctgggccaccaacatacaagtggccataaaccaagtgagaaggctcattgggaatgagaattatctagacttcatgacatcaatgaagagattcaaaaacgagagtgatcccgaaggggcactctggtaa

SEQ ID NO: 14 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaattggtgatggcttttatagcattcctaagatttctagccatacctccaacagcaggaattttggctagatggggctcattcaagaagaatggagcgatcaaagtgttacggggtttcaagaaagaaatctcaaacatgttgaacataatgaacaggaggaaaagatctgtgaccatgctcctcatgctgctgcccacagccctggcgttccatctgaccacccgagggggagagccgcacatgatagttagcaagcaggaaagaggaaaatcacttttgtttaagacctctgcaggtgtcaacatgtgcacccttattgcaatggatttgggagagttatgtgaggacacaatgacctacaaatgcccccggatcactgagacggaaccagatgacgttgactgttggtgcaatgccacggagacatgggtgacctatggaacatgttctcaaactggtgaacaccgacgagacaaacgttccgtcgcactggcaccacacgtagggcttggtctagaaacaagaaccgaaacgtggatgtcctctgaaggcgcttggaaacaaatacaaaaagtggagacctgggctctgagacacccaggattcacggtgatagccctttttctagcacatgccataggaacatccatcacccagaaagggatcatttttattttgctgatgctggtaactccatccatggccatgcggtgcgtgggaataggcaacagagacttcgtggaaggactgtcaggagctacgtgggtggatgtggtactggagcatggaagttgcgtcactaccatggcaaaagacaaaccaacactggacattgaactcttgaagacggaggtcacaaaccctgccgtcctgcgcaaactgtgcattgaagctaaaatatcaaacaccaccaccgattcgagatgtccaacacaaggagaagccacgctggtggaagaacaggacacgaactttgtgtgtcgacgaacgttcgtggacagaggctggggcaatggttgtgggctattcggaaaaggtagcttaataacgtgtgctaagtttaagtgtgtgacaaaactggaaggaaagatagtccaatatgaaaacttaaaatattcagtgatagtcaccgtacacactggagaccagcaccaagttggaaatgagaccacagaacatggaacaactgcaaccataacacctcaagctcccacgtcggaaatacagctgacagactacggagctctaacattggattgttcacctagaacagggctagactttaatgagatggtgttgttgacaatggaaaaaaaatcatggctcgtccacaaacaatggtttctagacttaccactgccttggacctcgggggcttcaacatcccaagagacttggaatagacaagacttgctggtcacatttaagacagctcatgcaaaaaagcaggaagtagtcgtactaggatcacaagaaggagcaatgcacactgcgttgactggagcgacagaaatccaatcgtctggaacgacaacaatttttgcaggacacctgaaatgcagactaaaaatggataaactgactttaaaagggatgtcatatgtaatgtgcacagggtcattcaagttagagaaggaagtggctgagacccagcatggaactgttctagtgcaggttaaatacgaaggaacagatgcaccatgcaagatccccttctcgtcccaagatgagaagggagtaacccagaatgggagattgataacagccaaccccatagtcactgacaaagaaaaaccagtcaacattgaagcggagccaccttttggtgagagctacattgtggtaggagcaggtgaaaaagctttgaaactaagctggttcaagaagggaagcagtatagggaaaatgtttgaagcaactgcccgtggagcacgaaggatggccatcctgggagacactgcatgggacttcggttctataggaggggtgttcacgtctgtgggaaaactgatacaccagatttttgggactgcgtatggagttttgttcagcggtgtttcttggaccatgaagataggaatagggattctgctgacatggctaggattaaactcaaggagcacgtccctttcaatgacgtgtatcgcagttggcatggtcacactgtacctaggagtcatggttcaggcggactcgggatgtgtaatcaactggaaaggcagagaactcaaatgtggaagcggcatttttgtcaccaatgaagtccacacctggacagagcaatataaattccaggccgactcccctaagagactatcagcggccattgggaaggcatgggaggagggtgtgtgtggaattcgatcagccactcgtctcgagaacatcatgtggaagcaaatatcaaatgaattaaaccacatcttacttgaaaatgacatgaaatttacagtggtcgtaggagacgttagtggaatcttggcccaaggaaagaaaatgattaggccacaacccatggaacacaaatactcgtggaaaagctggggaaaagccaaaatcataggagcagatgtacagaataccaccttcatcatcgacggcccaaacaccccagaatgccctgataaccaaagagcatggaacatttgggaagttgaagactatggatttggaattttcacgacaaacatatggttgaaattgcgtgactcctacactcaagtgtgtgaccaccggctaatgtcagctgccatcaaggatagcaaagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagatatatggaggaccaatatctcagcacaactacagaccaggatatttcacacaaacagcagggccgtggcacttgggcaagttagaactagattttgatttatgtgaaggtaccactgttgttgtggatgaacattgtggaaatcgaggaccatctcttagaaccacaacagtcacaggaaagacaatccatgaatggtgctgtagatcttgcacgttaccccccctacgtttcaaaggagaagacgggtgctggtacggcatggaaatcagaccagtcaaggagaaggaagagaacctagttaagtcaatggtctctgcagggtcaggagaagtggacagtttttcactaggactgctatgcatatcaataatgatcgaagaggtaatgagatccagatggagcagaaaaatgctgatgactggaacattggctgtgttcctccttctcacaatgggacaattgacatggaatgatctgatcaggctatgtatcatggttggagccaacgcttcagacaagatggggatgggaacaacgtacctagctttgatggccactttcagaatgagaccaatgttcgcagtcgggctactgtttcgcagattaacatctagagaagttcttcttcttacagttggattgagtctggtggcatctgtagaactaccaaattccttagaggagctaggggatggacttgcaatgggcatcatgatgttgaaattactgactgattttcagtcacatcagctatgggctaccttgctgtctttaacatttgtcaaaacaactttttcattgcactatgcatggaagacaatggctatgatactgtcaattgtatctctcttccctttatgcctgtccacgacttctcaaaaaacaacatggcttccggtgttgctgggatctcttggatgcaaaccactaaccatgtttcttataacagaaaacaaaatctggggaaggaaaagctggcctctcaatgaaggaattatggctgttggaatagttagcattcttctaagttcacttctcaagaatgatgtgccactagctggcccactaatagctggaggcatgctaatagcatgttatgtcatatctggaagctcggccgatttatcactggagaaagcggctgaggtctcctgggaagaagaagcagaacactctggtgcctcacacaacatactagtggaggtccaagatgatggaaccatgaaaataaaggatgaagagagagatgacacactcaccattctcctcaaagcaactctgctagcaatctcaggggtatacccaatgtcaataccggcgaccctctttgtgtggtatttttggcagaaaaagaaacagagatcaggagtgctatgggacacacccagccctccagaagtggaaagagcagtccttgatgatggcatttatagaattctccaaagaggattgttgggcaggtctcaagtaggagtaggagtttttcaagaaggcgtgttccacacaatgtggcacgtcaccaggggagctgtcctcatgtaccaagggaagagactggaaccaagttgggccagtgtcaaaaaagacttgatctcatatggaggaggttggaggtttcaaggatcctggaacgcgggagaagaagtgcaggtgattgctgttgaaccggggaagaaccccaaaaatgtacagacagcgccgggtaccttcaagacccctgaaggcgaagttggagccatagctctagactttaaacccggcacatctggatctcctatcgtgaacagagagggaaaaatagtaggtctttatggaaatggagtggtgacaacaagtggtacctacgtcagtgccatagctcaagctaaagcatcacaagaagggcctctaccagagattgaggacgaggtgtttaggaaaagaaacttaacaataatggacctacatccaggatcgggaaaaacaagaagataccttccagccatagtccgtgaggccataaaaagaaagctgcgcacgctagtcttagctcccacaagagttgtcgcttctgaaatggcagaggcgctcaagggaatgccaataaggtatcagacaacagcagtgaagagtgaacacacgggaaaggagatagttgaccttatgtgtcacgccactttcactatgcgtctcctgtctcctgtgagagttcccaattataatatgattatcatggatgaagcacatttcaccgatccagccagcatagcagccagagggtatatctcaacccgagtgggtatgggtgaagcagctgcgattttcatgacagccactccccccggatcggtggaggcctttccacagagcaatgcagttatccaagatgaggaaagagacattcctgaaagatcatggaactcaggctatgactggatcactgatttcccaggtaaaacagtctggtttgttccaagcatcaaatcaggaaatgacattgccaactgtttaagaaagaatgggaaacgggtggtccaattgagcagaaaaacttttgacactgagtaccagaaaacaaaaaataacgactgggactatgttgtcacaacagacatatccgaaatgggagcaaacttccgagccgacagggtaatagacccgaggcggtgcctgaaaccggtaatactaaaagatggcccagagcgtgtcattctagccggaccgatgccagtgactgtggctagcgccgcccagaggagaggaagaattggaaggaaccaaaataaggaaggcgatcagtatatttacatgggacagcctctaaaaaatgatgaggaccacgcccattggacagaagcaaaaatgctccttgacaacataaacacaccagaagggattatcccagccctctttgagccggagagagaaaagagtgcagcaatagacggggaatacagactacggggtgaagcgaggaaaacgttcgtggagctcatgagaagaggagatctacctgtctggctatcctacaaagttgcctcagaaggcttccagtactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaacgccttggacaatctggttatgttgcacaactctgaacaaggaggaaaagcctatagacacgccatggaagaactaccagacaccatagaaacgttaatgctcctagctttgatagctgtgctgactggtggagtgacgttgttcttcctatcaggaaggggtctaggaaaaacatccattggcctactctgcgtgattgcctcaagtgcactgttatggatggccagtgtggaaccccattggatagcggcctctatcatactggagttctttctgatggtgttgcttattccagagccggacagacagcgcactccacaagacaaccagctagcatacgtggtgataggtctgttattcatgatattgacagtggcagccaatgagatgggattactggaaaccacaaagaaggacctggggattggtcatgcagctgctgaaaaccaccatcatgctgcaatgctggacgtagacctacatccagcttcagcctggactctctatgcagtggccacaacaattatcactcccatgatgagacacacaattgaaaacacaacggcaaatatttccctgacagctattgcaaaccaggcagctatattgatgggacttgacaagggatggccaatatcaaagatggacataggagttccacttctcgccttggggtgctattctcaggtgaacccgctgacgctgacagcggcggtatttatgctagtggctcattatgccataattggacccggactgcaagcaaaagctactagagaagctcaaaaaaggacagcagccggaataatgaaaaacccaactgtcgacgggatcgttgcaatagatttggaccctgtggtttacgatgcaaaatttgaaaaacagctaggccaaataatgttgttgatactttgcacatcacagatcctcctgatgcggaccacatgggccttgtgtgaatccatcacactagccactggacctctgaccacgctttgggagggatctccaggaaaattctggaacaccacgatagcggtgtccatggcaaacatttttaggggaagttatctagcaggagcaggtctggccttttcattaatgaaatctctaggaggaggtaggagaggcacgggagcccaaggggaaacactgggagaaaaatggaaaagacagctaaaccaattgagcaagtcagaattcaacacttacaaaaggagtgggattatagaggtggatagatctgaagccaaagaggggttaaaaagaggagaaacgactaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacgaaaggaggacctggacatgaggaaccaatcccaatggcaacctatggatggaacctagtaaagctatactccgggaaagatgtattctttacaccacctgagaaatgtgacaccctcttgtgtgatattggtgagtcctctccgaacccaactatagaagaaggaagaacgttacgtgttctaaagatggtggaaccatggctcagaggaaaccaattttgcataaaaattctaaatccctatatgccgagtgtggtagaaactttggagcaaatgcaaagaaaacatggaggaatgctagtgcgaaatccactctcaagaaactccactcatgaaatgtactgggtttcatgtggaacaggaaacattgtgtcagcagtaaacatgacatctagaatgctgctaaatcgattcacaatggctcacaggaagccaacatatgaaagagacgtggacttaggcgctggaacaagacatgtggcagtagaaccagaggtggccaacctagatatcattggccagaggatagagaatataaaaaatgaacacaaatcaacatggcattatgatgaggacaatccatacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacagagggtgtttaaagagaaagttgacacgcgtacaccaaaagcgaaacgaggcacagcacaaattatggaggtgacagccaggtggttatggggttttctctctagaaacaaaaaacccagaatctgcacaagagaggagttcacaagaaaagtcaggtcaaacgcagctattggagcagtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaattaggagagttcggaaaggcaaaaggaagtcgcgcaatatggtacatgtggttgggagcgcgctttttagagtttgaagcccttggtttcatgaatgaagatcactggttcagcagagagaattcactcagtggagtggaaggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctattggccacgtcaatctttaagctaacctaccaaaacaaggtagtaagggtgcagagaccagcgaaaaatggaaccgtgatggatgtcatatccagacgtgaccagagaggaagtggacaggttggaacctatggcttaaacaccttcaccaacatggaggcccaactaataagacaaatggagtctgagggaatcttttcacccagcgaattggaaaccccaaatctagccgaaagagtcctcgactggttgaaaaaacatggcaccgagaggctgaaaagaatggcaatcagtggagatgactgtgtggtgaaaccaattgatgacagatttgcaacagccttaacagctttgaatgacatgggaaaggtaagaaaagacataccgcaatgggaaccttcaaaaggatggaatgattggcaacaagtgcctttctgttcacaccatttccaccagctgattatgaaggatgggagggagatagtggtgccatgccgcaaccaagatgaacttgtaggtagggccagagtatcacaaggcgccggatggagcttgagagaaactgcatgcctaggcaagtcatatgcacaaatgtggcagctgatgtacttccacaggagagacttgagattagcggctaatgctatctgttcagccgttccagttgattgggtcccaaccagccgtaccacctggtcgatccatgcccaccatcaatggatgacaacagaagacatgttgtcagtgtggaatagggtttggatagaggaaaacccatggatggaggacaagactcatgtgtccagttgggaagacgttccatacctaggaaaaagggaagatcaatggtgtggatccctaataggcttaacagcacgagccacctgggccaccaacatacaagtggccataaaccaagtgagaaggctcattgggaatgagaattatctagacttcatgacatcaatgaagagattcaaaaacgagagtgatcccgaaggggcactctggtaa

SEQ ID NO: 15 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaattggtgatggcttttatagcattcctaagatttctagccatacctccaacagcaggaattttggctagatggggctcattcaagaagaatggagcgatcaaagtgttacggggtttcaagaaagaaatctcaaacatgttgaacataatgaacaggaggaaaagatctgtgaccatgctcctcatgctgctgcccacagccctggcgttccatctgaccacccgagggggagagccgcacatgatagttagcaagcaggaaagaggaaaatcacttttgtttaagacctctgcaggtgtcaacatgtgcacccttattgcaatggatttgggagagttatgtgaggacacaatgacctacaaatgcccccggatcactgagatggaaccagatgacgttgactgttggtgcaatgccacggagacatgggtgacctatggaacatgttctcaaactggtgaacaccgacgagacaaacgttccgtcgcactggcaccacacgtagggcttggtctagaaacaagaaccgaaacgtggatgtcctctgaaggcgcttggaaacaaatacaaaaagtggagacctgggctctgagacacccaggattcacggtgatagccctttttctagcacatgccataggaacatccatcacccagaaagggatcatttttattttgctgatgctggtaactccatccatggccatgcggtgcgtgggaataggcaacagagacttcgtggaaggactgtcaggagctacgtgggtggatgtggtactggagcatggaagttgcgtcactaccatggcaaaagacaaaccaacactggacattgaactcttgaagacggaggtcacaaaccctgccgtcctgcgcaaactgtgcattgaagctaaaatatcaaacaccaccaccgattcgagatgtccaacacaaggagaagccacgctggtggaagaacaggacacgaactttgtgtgtcgacgaacgttcgtggacagaggctggggcaatggttgtgggctattcggaaaaggtagcttaataacgtgtgctaagtttaagtgtgtgacaaaactggaaggaaagatagtccaatatgaaaacttaaaatattcagtgatagtcaccgtacacactggagaccagcaccaagttggaaatgagaccacagaacatggaacaactgcaaccataacacctcaagctcccacgtcggaaatacagctgacagactacggagctctaacattggattgttcacctagaacagggctagactttaatgagatggtgttgttgacaatggaaaaaaaatcatggctcgtccacaaacaatggtttctagacttaccactgccttggacctcgggggcttcaacatcccaagagacttggaatagacaagacttgctggtcacatttaagacagctcatgcaaaaaagcaggaagtagtcgtactaggatcacaagaaggagcaatgcacactgcgttgactggagcgacagaaatccaaacgtctggaacgacaacaatttttgcaggacacctgaaatgcagactaaaaatggataaactgactttaaaagggatgtcatatgtaatgtgcacagggtcattcaagttagagaaggaagtggctgagacccagcatggaactgttctagtgcaggttaaatacgaaggaacagatgcaccatgcaagatccccttctcgtcccaagatgagaagggagtaacccagaatgggagattgataacagccaaccccatagtcactgacaaagaaaaaccagtcaacattgaagcggagccaccttttggtgagagctacattgtggtaggagcaggtgaaaaagctttgaaactaagctggttcaagaagggaagcagtatagggaaaatgtttgaagcaactgcccgtggagcacgaaggatggccatcctgggagacactgcatgggacttcggttctataggaggggtgttcacgtctgtgggaaaactgatacaccagatttttgggactgcgtatggagttttgttcagcggtgtttcttggaccatgaagataggaatagggattctgctgacatggctaggattaaactcaaggagcacgtccctttcaatgacgtgtatcgcagttggcatggtcacactgtacctaggagtcatggttcaggcggactcgggatgtgtaatcaactggaaaggcagagaactcaaatgtggaagcggcatttttgtcaccaatgaagtccacacctggacagagcaatataaattccaggccgactcccctaagagactatcagcggccattgggaaggcatgggaggagggtgtgtgtggaattcgatcagccactcgtctcgagaacatcatgtggaagcaaatatcaaatgaattaaaccacatcttacttgaaaatgacatgaaatttacagtggtcgtaggagacgttagtggaatcttggcccaaggaaagaaaatgattaggccacaacccatggaacacaaatactcgtggaaaagctggggaaaagccaaaatcataggagcagatgtacagaataccaccttcatcatcgacggcccaaacaccccagaatgccctgataaccaaagagcatggaacatttgggaagttgaagactatggatttggaattttcacgacaaacatatggttgaaattgcgtgactcctacactcaagtgtgtgaccaccggctaatgtcagctgccatcaaggatagcaaagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagatatatggaggaccaatatctcagcacaactacagaccaggatatttcacacaaacagcagggccgtggcacttgggcaagttagaactagattttgatttatgtgaaggtaccactgttgttgtggatgaacattgtggaaatcgaggaccatctcttagaaccacaacagtcacaggaaagacaatccatgaatggtgctgtagatcttgcacgttaccccccctacgtttcaaaggagaagacgggtgctggtacggcatggaaatcagaccagtcaaggagaaggaagagaacctagttaagtcaatggtctctgcagggtcaggagaagtggacagtttttcactaggactgctatgcatatcaataatgatcgaagaggtaatgagatccagatggagcagaaaaatgctgatgactggaacattggctgtgttcctccttctcacaatgggacaattgacatggaatgatctgatcaggctatgtatcatggttggagccaacgcttcagacaagatggggatgggaacaacgtacctagctttgatggccactttcagaatgagaccaatgttcgcagtcgggctactgtttcgcagattaacatctagagaagttcttcttcttacagttggattgagtctggtggcatctgtagaactaccaaattccttagaggagctaggggatggacttgcaatgggcatcatgatgttgaaattactgactgattttcagtcacatcagctatgggctaccttgctgtctttaacatttgtcaaaacaactttttcattgcactatgcatggaagacaatggctatgatactgtcaattgtatctctcttccctttatgcctgtccacgacttctcaaaaaacaacatggcttccggtgttgctgggatctcttggatgcaaaccactaaccatgtttcttataacagaaaacaaaatctggggaaggaaaagctggcctctcaatgaaggaattatggctgttggaatagttagcattcttctaagttcacttctcaagaatgatgtgccactagctggcccactaatagctggaggcatgctaatagcatgttatgtcatatctggaagctcggccgatttatcactggagaaagcggctgaggtctcctgggaagaagaagcagaacactctggtgcctcacacaacatactagtggaggtccaagatgatggaaccatgaaaataaaggatgaagagagagatgacacactcaccattctcctcaaagcaactctgctagcaatctcaggggtatacccaatgtcaataccggcgaccctctttgtgtggtatttttggcagaaaaagaaacagagatcaggagtgctatgggacacacccagccctccagaagtggaaagagcagtccttgatgatggcatttatagaattctccaaagaggattgttgggcaggtctcaagtaggagtaggagtttttcaagaaggcgtgttccacacaatgtggcacgtcaccaggggagctgtcctcatgtaccaagggaagagactggaaccaagttgggccagtgtcaaaaaagacttgatctcatatggaggaggttggaggtttcaaggatcctggaacgcgggagaagaagtgcaggtgattgctgttgaaccggggaagaaccccaaaaatgtacagacagcgccgggtaccttcaagacccctgaaggcgaagttggagccatagctctagactttaaacccggcacatctggatctcctatcgtgaacagagagggaaaaatagtaggtctttatggaaatggagtggtgacaacaagtggtacctacgtcagtgccatagctcaagctaaagcatcacaagaagggcctctaccagagattgaggacgaggtgtttaggaaaagaaacttaacaataatggacctacatccaggatcgggaaaaacaagaagataccttccagccatagtccgtgaggccataaaaagaaagctgcgcacgctagtcttagctcccacaagagttgtcgcttctgaaatggcagaggcgctcaagggaatgccaataaggtatcagacaacagcagtgaagagtgaacacacgggaaaggagatagttgaccttatgtgtcacgccactttcactatgcgtctcctgtctcctgtgagagttcccaattataatatgattatcatggatgaagcacatttcaccgatccagccagcatagcagccagagggtatatctcaacccgagtgggtatgggtgaagcagctgcgattttcatgacagccactccccccggatcggtggaggcctttccacagagcaatgcagttatccaagatgaggaaagagacattcctgaaagatcatggaactcaggctatgactggatcactgatttcccaggtaaaacagtctggtttgttccaagcatcaaatcaggaaatgacattgccaactgtttaagaaagaatgggaaacgggtggtccaattgagcagaaaaacttttgacactgagtaccagaaaacaaaaaataacgactgggactatgttgtcacaacagacatatccgaaatgggagcaaacttccgagccgacagggtaatagacccgaggcggtgcctgaaaccggtaatactaaaagatggcccagagcgtgtcattctagccggaccgatgccagtgactgtggctagcgccgcccagaggagaggaagaattggaaggaaccaaaataaggaaggcgatcagtatatttacatgggacagcctctaaaaaatgatgaggaccacgcccattggacagaagcaaaaatgctccttgacaacataaacacaccagaagggattatcccagccctctttgagccggagagagaaaagagtgcagcaatagacggggaatacagactacggggtgaagcgaggaaaacgttcgtggagctcatgagaagaggagatctacctgtctggctatcctacaaagttgcctcagaaggcttccagtactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaacgccttggacaatctggttatgttgcacaactctgaacaaggaggaaaagcctatagacacgccatggaagaactaccagacaccatagaaacgttaatgctcctagctttgatagctgtgctgactggtggagtgacgttgttcttcctatcaggaaggggtctaggaaaaacatccattggcctactctgcgtgattgcctcaagtgcactgttatggatggccagtgtggaaccccattggatagcggcctctatcatactggagttctttctgatggtgttgcttattccagagccggacagacagcgcactccacaagacaaccagctagcatacgtggtgataggtctgttattcatgatattgacagtggcagccaatgagatgggattactggaaaccacaaagaaggacctggggattggtcatgcagctgctgaaaaccaccatcatgctgcaatgctggacgtagacctacatccagcttcagcctggactctctatgcagtggccacaacaattatcactcccatgatgagacacacaattgaaaacacaacggcaaatatttccctgacagctattgcaaaccaggcagctatattgatgggacttgacaagggatggccaatatcaaagatggacataggagttccacttctcgccttggggtgctattctcaggtgaacccgctgacgctgacagcggcggtatttatgctagtggctcattatgccataattggacccggactgcaagcaaaagctactagagaagctcaaaaaaggacagcagccggaataatgaaaaacccaactgtcgacgggatcgttgcaatagatttggaccctgtggtttacgatgcaaaatttgaaaaacagctaggccaaataatgttgttgatactttgcacatcacagatcctcctgatgcggaccacatgggccttgtgtgaatccatcacactagccactggacctctgaccacgctttgggagggatctccaggaaaattctggaacaccacgatagcggtgtccatggcaaacatttttaggggaagttatctagcaggagcaggtctggccttttcattaatgaaatctctaggaggaggtaggagaggcacgggagcccaaggggaaacactgggagaaaaatggaaaagacagctaaaccaattgagcaagtcagaattcaacacttacaaaaggagtgggattatagaggtggatagatctgaagccaaagaggggttaaaaagaggagaaacgactaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacgaaaggaggacctggacatgaggaaccaatcccaatggcaacctatggatggaacctagtaaagctatactccgggaaagatgtattctttacaccacctgagaaatgtgacaccctcttgtgtgatattggtgagtcctctccgaacccaactatagaagaaggaagaacgttacgtgttctaaagatggtggaaccatggctcagaggaaaccaattttgcataaaaattctaaatccctatatgccgagtgtggtagaaactttggagcaaatgcaaagaaaacatggaggaatgctagtgcgaaatccactctcaagaaactccactcatgaaatgtactgggtttcatgtggaacaggaaacattgtgtcagcagtaaacatgacatctagaatgctgctaaatcgattcacaatggctcacaggaagccaacatatgaaagagacgtggacttaggcgctggaacaagacatgtggcagtagaaccagaggtggccaacctagatatcattggccagaggatagagaatataaaaaatgaacacaaatcaacatggcattatgatgaggacaatccatacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacagagggtgtttaaagagaaagttgacacgcgtacaccaaaagcgaaacgaggcacagcacaaattatggaggtgacagccaggtggttatggggttttctctctagaaacaaaaaacccagaatctgcacaagagaggagttcacaagaaaagtcaggtcaaacgcagctattggagcagtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaattaggagagttcggaaaggcaaaaggaagtcgcgcaatatggtacatgtggttgggagcgcgctttttagagtttgaagcccttggtttcatgaatgaagatcactggttcagcagagagaattcactcagtggagtggaaggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctattggccacgtcaatctttaagctaacctaccaaaacaaggtagtaagggtgcagagaccagcgaaaaatggaaccgtgatggatgtcatatccagacgtgaccagagaggaagtggacaggttggaacctatggcttaaacaccttcaccaacatggaggcccaactaataagacaaatggagtctgagggaatcttttcacccagcgaattggaaaccccaaatctagccgaaagagtcctcgactggttgaaaaaacatggcaccgagaggctgaaaagaatggcaatcagtggagatgactgtgtggtgaaaccaattgatgacagatttgcaacagccttaacagctttgaatgacatgggaaaggtaagaaaagacataccgcaatgggaaccttcaaaaggatggaatgattggcaacaagtgcctttctgttcacaccatttccaccagctgattatgaaggatgggagggagatagtggtgccatgccgcaaccaagatgaacttgtaggtagggccagagtatcacaaggcgccggatggagcttgagagaaactgcatgcctaggcaagtcatatgcacaaatgtggcagctgatgtacttccacaggagagacttgagattagcggctaatgctatctgttcagccgttccagttgattgggtcccaaccagccgtaccacctggtcgatccatgcccaccatcaatggatgacaacagaagacatgttgtcagtgtggaatagggtttggatagaggaaaacccatggatggaggacaagactcatgtgtccagttgggaagacgttccatacctaggaaaaagggaagatcaatggtgtggatccctaataggcttaacagcacgagccacctgggccaccaacatacaagtggccataaaccaagtgagaaggctcattgggaatgagaattatctagacttcatgacatcaatgaagagattcaaaaacgagagtgatcccgaaggggcactctggtaa

SEQ ID NO: 16 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaactggtgatggcttttatagcattcctaagatttctagccatacctccaacagcaggaattttggctagatggggctcattcaagaagaatggagcgattaaagtgttgcggggtttcaaaaaagaaatctcaaacatgttgaacataatgaacaggaggaaaagatctgtgaccatgctcctcatgctactgcccacagccctgacgttccatctgaccacccgagggggagagccgcacatgatagttggcaagcaggaaagaggaaagtcacttttgtttaagacctctgcaggtgtcaacatgtgtacccttattgcaatggatctgggagagttatgtgatgacacgatgacctacaaatgcccccggatcactgagacggaaccagatgacgttgactgttggtgcaatgccacggagacatgggtgacctatggaacatgttctcaaaccggtgaacaccgacgagacaaacgttccgttgcactggcaccacacgtagggcttggtctggaaacaagaaccgaaacgtggatgtcctctgaaggcgcttggagacaaatacaaaaagtggagacatgggccctgagacacccaggattcacggtgatagccctttttctagcacatgtcatagggacatccatcacccagaaagggattattttcattttgctgatgctggtaactccatccatggccatgcggtgcgtgggaataggaaacagagacttcgtggaaggactgtcaggagctacgtgggtggatgtagtactggagcatggaagttgtgtcactaccatggcaaaagacaaaccaacactggacattgaactcttgaagacggaggtcacaaaccctgccgtcttgcgcaaactgtgcattgaagccaaaatatcaaataccaccactgattcgagatgtccgacacaaggagaagccacgttggtggaagaacaagacacgaactttgtgtgtcgacgaacgttcgtggacagaggctggggcaatggttgtggactattcggaaaaggtagcttaataacgtgtgctaagtttaagtgtgtgacaaaattggaaggaaagatagtccaatatgaaaacttaaaatactcagtgatcgttaccgtccacactggagaccagcaccaagttggaaatgagaccacagaacatggaacaattgcaaccataacacctcaagctcccacgtcggaaatacaactgacagactacggagctctgacactggactgttcacctagaacagggctagactttaatgagatggtgttgttgacaatgaaagaaaaatcatggctcgtccacaaacaatggtttctagacttaccactgccttggacttcaggggcttcaacatcccaagagacttggaatagacaagacttgctggtcacatttaagacagctcatgcaaagaagcaggaagtagtcgtactaggatcacaagaaggagcaatgcatactgcgttgactggagctacagaaatccaaacgtctggaacgacaacaatttttgcaggccatctgaaatgcagactaaaaatggacaaactgactctaaaaggaatatcatatgtaatgtgcacaggctcattcaagttagagaaggaagtggctgagacccagcatggaactgttctagtacaggttaaatacgaaggaacagatgcaccatgcaagatccccttctcgtcccaagatgagaagggagtaacccagaatgggagattggtaacggccaaccccatagtcactgacaaagaaaaaccagtcaatattgaggcggagccaccttttggtgagagttacatcgtggtaggagcaggagaaaaagctttgaaactaagctggttcaagaagggaagcagcatagggaaaatgtttgaagcaactgcccgtggagcacgaaggatggccatcttgggagacaccgcatgggacttcggttctataggaggagtgttcacgtctgtgggaaaactggtacaccagatttttggaactgcgtatggagtcttgttcagtggtgtctcttggaccatgaaaataggaatagggattctgctgacatggctgggattaaactcaaggagcacgtctctttcaatgacgtgtatcgcagttgggctgatcacactgtacctaggagtcatggtccaggcggactcgggatgtgtaatcaactggaaaggcagagaactcaaatgtggaagcggcatttttgtcaccaatgaagttcacacctggacagagcaatacaaatttcaggccgactccccaaagagactatcagcagccattgggaaggcatgggaggaaggtgtgtgtggaattcgatcagccacccgtctcgagaacatcatgtggaagcaaatatcaaatgaattaaaccacatcttacttgaaaatgacatgaaatttacagtggtcgtaggagacgttagtggaatcttggcccaaggaaagaaatcgattaggccacaacccatggaacataaatactcgtggaaaagctggggaaaagccaaaatcattggagcagatgttcagaacactactttcatcatcgacggcccaaacaccccagaatgccctgatgaccaaagagcatggaacatctgggaagttgaagactatggatttggaattttcacgacaaacatatggttgaaattgcgtgactcctacacccaagtgtgtgaccatcgactaatgtcagctgccatcaaggatagcaaagcagtccatgctgacatggggtactggatagaaagtgaaaagaacgagacttggaagttggcaagagcctccttcatagaagtcaagacatgcatctggccaaagtctcacactctatggagcaatggagtcctggaaagtgagatgataatcccaaagatatatggaggaccaatatctcagcataattacagaccaggatatttcacacaaacagcaggaccgtggcacttaggcaagttggaactagattttgatttgtgtgaaggtaccacagttgttgtagatgaacactgtggaaatagaggaccatctcttagaaccacaacagtcacaggaaagataatccatgaatggtgctgtagatcttgcacgttaccccccctacgtttcaaaggagaagacgggtgctggtatggcatggaaatcagaccagtcaaggagaaggaagagaacctagtcaagtcaatggtctctgcagggtcaggagaggtggacagtttttcactaggactgttgtgcatatcaataatgatcgaagaggtaatgagatccagatggagcaggaaaatgctgatgactggaacattggctgtgttcctccttctcacaatgggacaattgacatggaacgatctaatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagaggagctaggggatggacttgcaatgggcatcatgatattaaaattactaactgattttcaatcacatcagctatgggccaccttgctgtctctgacatttgtcaaaacaaccttttcattgcactacgcatggaagacaatggctatgatactgtcaattgtatctctcttccctttatgcctgtccacgacttctcaaaaaacaacatggcttccggtgcttctggggtctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcgtgttatgtcatatccggaagctcggccgatttatcactggagaaagcggctgaggtctcctgggaagaagaagcagaacactctggtgcctcacacaacatactagtggagatccaagatgatggaaccatgaagataaaagatgaagagagagatgacacgatcaccatcctcctcaaagcaaccttgctagcaatctcaggggtatacccaatgtcaataccggcgactctctttgtgtggtatttttggcagaaaaagaaacagagatcaggagtgctatgggacacaccaagccctccagaagtggaaagagcagtccttgatgatggcatttatagaattctccaaaggggattgttgggcaggtctcaagtaggagtaggagttttccaagaaggcgtattccacacaatgtggcatgtcaccaggggagctgttctcatgtaccaagggaagagattggaaccaagttgggccagtgtcaaaaaagacttgatctcatatggaggaggctggaggtttcaaggatcctggaacacgggagaagaagtgcaggtgattgctgttgaaccagggaagaacccaaaaaatgtacagacagcgccgggtaccttcaagacctctgaaggcgaagttggagccatagctctagactttaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttttagctcccacaagggttgtcgcctctgaaatggcagaggcgctcaagggaatgccaataaggtatcagacaacagcagtgaagagtgaacacacgggaagggagatagttgaccttatgtgtcacgccactttcactatgcgtctcctgtctcctgtgagagttcccaattacaacatgataatcatggatgaagcacatttcaccgatccagccagcatagcagccagagggtacatctcaacccgagtgggtatgggtgaagcagctgcgattttcatgacagccactccccccggatcggtggaggcctttccacagagcaatgcagttatccaagatgaggagaaagacattcctgaaagatcatggaactcaggctatgactggatcactgatttcccaggtaaaacagtctggttcgttccaagcatcaaatcaggaaatgacattgccaactgtttaagaaaaaatgggaaacgggtgatccaattgagcagaaaaacttttgacactgagtaccagaaaacgaaaaataacgactgggactatgttgtcacaacagacatttccgaaatgggagcaaactttcgagccgacagggtaatagacccaaggcgatgcctgaaaccggtaatactgaaagatggtccagagcgtgtcattctagccggaccgatgccagtgaccgtggctagtgccgcccagaggagaggaagaattggaaggaaccaaaataaggaaggtgatcagtatatttacatgggacagcctttaaataacgatgaggaccacgcccattggacagaagcaaaaatgctccttgacaacataaacacaccagaagggatcatcccagccctctttgagccagaaagagaaaagagtgctgcaatagacggggaatacagactacggggtgaagcgaggaaaacgtttgtggagctcatgagaagaggagatctacctgtctggctatcttacaaagttgcctcagaaggcttccaatactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttcctcaacatctaactcaaagggcccagaatgctttggacaatttggttatgctgcacaactctgaacaaggaggaaaagcttatagacacgccatggaagaattgccagacactatagagacgttgatgctcctagctctgatagctgtgctgactggtggagtgacgctgttcttcctatcaggaagaggcttagggaaaacatccattggcctactctgcgtgatgtcctcaagtgcactgttatggatggccagtgtggagccccattggatagcggcctctatcatactggagttctttctgatggtgttgcttattccggagccagacagacagcgcactccacaagacaaccagttagcatatgtggtgataggcttgttattcatgatattgacagtggcagccaatgagatgggattattggaaaccacaaagaaagacctggggattggtcatgcagctgctgaaaaccaccaccacgccgcaatgctggacgtagacctacatccagcttcagcctggactctctacgcagtggccacaacgattatcactcccatgatgagacacacaattgaaaacacaacggcaaacatttccctgacagccattgcaaaccaggcagctatattgatgggacttgataagggatggccaatatcaaagatggacataggagttccacttctcgccttggggtgctattctcaggtgaacccgctgacgctgacagcggcggtactgatgctagtggctcattatgccataattggaccaggactgcaagcaaaagccactagagaagctcaaaaaagaacagcagccggaataatgaaaaacccaactgtcgacgggatcgttgcaatagatttagaccctgtggtttatgatgcaaaatttgaaaaacagctaggccaaataatgttgttgatactatgcacatctcagattctcttgatgcggaccacatgggccttgtgtgaatccatcacactggccacaggacctctgaccacgctttgggagggatctccaggaaaattctggaacaccacgatagcggtgtccatggcaaacatttttagggggagttatctagcaggagcgggtctggccttttcattaatgaaatctctaggaggaggtaggagagggacgggagcccaaggagaaacactgggagaaaagtggaaaagacagctaaaccaattgagcaagtcagaatttaacatttacaagaggagtggtattgtagaggtggatagatctgaagccaaggaggggttaaaaagaggagaaacaatcaaacacgcagtgtcgagaggaacggccaaactgaggtggtttgtggagaggaaccttgtgaaaccagaagggaaagtcatagacctcggctgtggaagaggtggctggtcatattactgcgctgggctgaagaaagtcacagaagtgaaaggatacacaaaaggaggacctggacatgaggaaccaatcccaatggcaacctatggatggaacctagtaaagctatactccgggaaagatgtattctttataccacctgagaaatgtgacacccttttgtgtgatattggtgagtcctctccgaacccgactatagaagaaggaagaacgttgcgtgttctaaagatggtagaaccatggctcagaggaaaccaattttgcataaagattctaaatccctacatgccgagtgtggtagaaactctggagcaaatgcaaagaaaacatggaggaatgctagtgcgaaatccactctcaagaaactccactcatgaaatgtactgggtttcatgtggaacaggaaacattgtgtcagcagtaaatatgacatctagaatgctgctgaatcgattcacgatggctcacaggaagccaacatatgaaagagatgtggacttgggcgctggaacgagacatgtggcagtagaaccagaggtggccaacctagacatcattggccagaggatagagaatataaaaaatgaacacaaatcaacatggcattatgatgaggacaacccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgataccacaccctttggacaacaaagggtgtttaaagagaaagttgacacgcgtacaccaaaagcgaaacgaggcacagcacaaattatggaggtgacagccaagtggttatggggttttctctccagaaacaaaaaacccagaatctgcacaagagaggagttcacaagaaaagtcaggtcaaatgcagctattggagcggtgttcgttgatgaaaatcaatggaactcagcaaaagaggcagtggaagatgaaaggttctgggatcttgtgcgcagagagagggagcttcataaacaaggaaaatgtgccacgtgtgtctacaacatgatgggaaagagagagaaaaaattaggagagttcggaaaggccaaaggaagtcgcgcaatatggtatatgtggttgggagcgcgcttcttagagtttgaagccctcggcttcatgaatgaagatcactggttcagcagagagaattcactcagtggagtggaaggagaaggactccacaaacttggatacatactcagagacatatcaaagattccagggggaaacatgtatgcagatgatacagccggatgggacacaagaataacagaggatgatcttcagaatgaggccaaaatcactgacatcatggaacctgaacacgccctactggccacgtcaatctttaagttaacctaccaaaacaaggttgtaagagtgcagagaccagcaaaaaatggaaccgtgatggatgtcatatccaggcgtgaccagagaggaagtggacaggttggaacttatggcttaaacaccttcaccaacatgggggcccaactaataagacaaatggagtctgagggaatcttttcacccagtgaattggaaaccccaaatttagctggaagagtccttgactggttggaaaaacatggcatcgagaggctgagaagaatggcaatcagtggagatgactgcgtggtgaaaccaattgatgacagatttgcaacagccttaacagccttgaatgacatgggaaaggtaagaaaagacataccgcaatgggaaccttcaaaaggatggaatgattggcaacaagtgcctttctgctcacaccacttccaccagctgattatgaaggatggaagggaaatagtagtgccatgccgcaaccaagatgaactggtaggtagggccagagtatcacaaggtgccggatggagcttgagagaaactgcatgtctaggcaagtcgtatgcacaaatgtggcagctgatgtacttccacaggagagacttgagattagcggctaatgctatttgttcagccgttccagttgattgggtcccaaccagtcgcaccacctggtcgatccatgcccaccatcaatggatgacaacagaagacatgttgtcagtgtggaatagggtttggatagaggaaaacccatggatggaggataaaactcacgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattacctagactacatgacatcaatgaagagattcaaaaacgagagtgatcccgaaggggcactctggtaa

SEQ ID NO: 17 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcactcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggaaacttgggccctgagacacccaggattcacggtgatagctctttttctagcacatgccataggaacatccatcacccagaaagggattattttcattttgttaatgctggtaacaccatccatggccatgcgatgtgtgggaataggcagcagggacttcgtggaaggactgtcaggagcaacttgggtagatgtggtactggaacatggaagttgcgtcaccaccatggcaaaagacaaaccaacattggacattgaactcctgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggtaatggctgtgggctcttcggtaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagtacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgttctaggatcacaggaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaactgttctagtgcagattaaatacgaaggaacagatgcaccatgcaagatccctttttcgacccaagatgaaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaattcaaggagcacgtccctctcgatgacgtgtattgcagttggcctagtaacactatacctaggagtcatggttcaggcggattcaggatgtgtagttaattggaaaggtagagaactcaaatgtggaagtggcatttttgtcaccaatgaagttcacacttggacagagcaatacaaatttcaagctgactccccaaagagattatcagcagccattgggaaggcatgggaggagggtgtgtgtggaattcgatcagcaactcgtctcgagaacatcatgtggaagcaaatatcaaatgaactgaatcacatcttacttgaaaatgacatgaaattcacagtggttgtaggagatgttgctgggatcttggctcaaggaaaaaaaatgattaggccacaacccatggaatacaaatactcgtggaaaagctggggaaaggctaaaatcataggggcagatgtacagaacaccaccttcatcatcgacggcccaaacaccccagaatgccctgatgaccaaagagcatggaacatttgggaagttgaggactatggatttggaattttcacgacaaacatatggctgagattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacggcagggccatggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacataacatattagtggaggtccaagatgatggaaccatgaagataaaggatgaagagagagatgacacgctaaccattctccttaaagcaactctgttagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaggtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatttcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgtttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctctttgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatgtatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctaacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggatagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaacccactttcaagaaattctactcatgaaatgtattgggtttcatgtggaacaggaaacattgtgtcagcagtaaacatgacatccagaatgttgctaaatcgattcacaatggctcacaggaaaccaacatatgaaacacacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagaccactggttcagcagagagaattcacttagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaagtcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagctctcgactggctggaaaaacatggcgtcgaaaggctgaaaagaatggcaatcagcggagatgactgcgtagtgaaaccaattgatgataggtttgcaacagccttaacagctctgaataatatgggaaaagtaagaaaagatataccacaatgggaaccttcaaaaggatggaatgattggcaacaagtgcctttttgttcacaccacttccaccagctgatcatgaaggatgggagggaaatagtggtgccatgccgcaaccaagatgaacttgtgggtagggctagagtatcacaaggtgccggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccaccaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacttgggccaccaacatacaagtggccataagccaagtgagaagactaattgggaatgagaattatctagattacatgacatcaatgaagagattcaagaacgagagtgatcccgaaggggcactctggtga

SEQ ID NO: 18 - DNA, 10206 bp, Dengue virus
atgaacaaccaacgaaaaaagacggctcgaccgtctttcaatatgctgaaacgcgcgagaaaccgcgtgtcaactggttcacagttggcgaagagattctcaaaaggattgctttcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaacataatgaatagaaggaaaagatctgtgaccatgctcctcatgctgctgcccacagccttggcgttccatttgactacacgagggggagagccacacatgatagttagcaagcaggaaagagaaaagtcactcttgtttaagacctctgtaggtgtcaacatgtgcacccttatagcgatggatttgggagagttatgtgaggacacaatgacttacaaatgccctcgaattactgaggcggaaccagatgacgttgattgttggtgcaatgctacagacacatgggtgacctatggaacatgttcccaaactggcgagcaccgacgggacaaacgttccgtcgcactggccccacacgtgggacttggtctagaaacaagaaccgaaacgtggatgtcctctgaaggcgcttggaaacaaatacaaagagtggagacttgggctttgcgacacccaggattcacggtgatagccctttttcttgcacatgccataggaacatccatcactcagaaagggattattttcattttgttaatgctagtaacaccatccatggccatgcgatgcgtgggaataggcagcagggacttcgtggaaggactatcaggagcaacttgggtagacgtggtactggaacatggaagttgcgtcaccaccatggcaaaagacaaaccaacattggacattgaactcctgaaaacggaggtcacgaaccctgccgtcctgcgcaaactgtgcattgaagctaaaatatcaaacaccaccaccgattcaagatgtccaacacaaggagaagctacactggtggaagaacaagacgcgaactttgtgtgtcgacgaacgttcgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaactgggctggactttaatgagatggtgctattgacaatgaaagaaaaatcatggcttgttcacaaacaatggtttctagacttaccactgccttggacttcgggggcttcaacatcccaagagacttggaacagacaagatttgctggtcacattcaagacagctcatgcaaagaagcaggaagtagtcgtactgggatcacaggaaggagcaatgcacactgcgttgactggggcgacagaaatccaaacgtctggaacgacaacaatttttgcaggacacctgaaatgtagactaaaaatggacaaactgactctaaaagggatgtcatatgtgatgtgcacaggctcatttaagctagagaaggaagtggctgagacccagcatggaactgttttagtgcaggttaaatacgaaggaacagatgcaccatgcaagatccccttttcgacccaagatgagaaaggagtgacccagaatagattgataacagccaatcctatagttactgacaaagaaaaaccagtcaacattgagacagaaccaccttttggtgagagctacatcgtggtaggggcaggtgaaaaagctttgaaacaatgctggttcaagaaaggaagcagcatagggaaaatgttcgaagcaaccgcccgaggagcacgaaggatggctatcctgggagacaccgcatgggacttcggttctataggaggagtgttcacgtctgtgggaaaattagtgcatcaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaactcaaatgtggaagtggcatttttgtcactaatgaagtccacacttggacagagcaatacaaatttcaagctgactccccaaaaagactatcagcagccatcggaaaggcatgggaggagggtgtgtgtggaattcgatcagccactcgtctcgagaacatcatgtggaagcaaatatcaaatgaactgaaccacatcttacttgaaaatgacatgaaattcacagtggttgtaggagatgttgttgggatcttggcccaagggaaaaaaatgattagaccacaacccatggaacacaaatactcatggaaaagctggggaaaagccaaaatcataggagcagacatacagaacaccaccttcatcattgacggcccagatactccagaatgtcctgatgaccaaagagcatggaacatttgggaagttgaggactatgggttcggaattttcacgacaaacatatggttgaaattgcgtgactcctacacccaaatgtgtgaccaccggctaatgtcagctgccatcaaggacagcaaggcagtccatgctgatatggggtactggatagaaagtgaaaagaacgagacctggaagctggcaagagcctctttcatagaagttaaaacatgtgtctggccaaaatcccacactctatggagcaatggagttctggaaagtgaaatgataattccaaagatctatggaggaccaatatctcagcacaactacagaccaggatatttcacacaaacggcagggccatggcacctaggcaagttggaactggattttgatttgtgtgagggtaccacagttgttgtggatgaacattgtggaaatcgaggtccatctcttagaaccacaacagtcacaggaaagataattcatgaatggtgttgcagatcttgtacgctaccacccttacgtttcaaaggagaagatggatgttggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagcagaaaaatgctgatgactggaacactggctgtgttcctccttctcataatgggacaattgacatggaatgatctgatcaggttatgcatcatggttggagccaatgcttcagacaggatggggatgggaacaacgtacctagctctgatggccacttttaaaatgagaccaatgtttgctgtcgggctgttgttccgcagactaacatctagagaagttcttcttcttacaattggattgagtctagtggcatctgtggagttaccaaattccctggaggagctgggggatggacttgcaatgggcattatgattttaaaattattgactgactttcagtcacatcagctgtgggctaccttgctgtccttgacatttgtcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttctcatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttacgttatatctggaagctcagccgacttatcactagagaaagcggctgaggtctcctgggaagaagaagcagaacactctggtgcctcacacaatatattagtggaggtccaagatgatggaaccatgaagataaaagatgaagagagagatgacacgctaaccattctccttaaagcaaccctgctagcagtttcaggggtgtacccattatcaataccagcaaccctttttgtgtggtacttttggcagaaaaagaaacaaagatctggagtgttatgggacacacctagccctccagaagtggaaagagcagtccttgatgatggtatctatagaattatgcagagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatatggaggaggttggaggtttcaaggatcctggaacacgggagaagaagtgcaggtgattgctgttgaaccaggaaaaaaccccaaaaatgtacagacagcgccgggtaccttcaagacccctgaaggtgaagttggagctattgccctagattttaaacccggcacatctggatctcccatcgtgaacagagaaggaaaaatagtaggtctttatggaaatggagtagtgacaacaagtggaacctacgtcagtgccatagcccaagccaaagcatcacaagaagggcccctaccagagattgaggacgaggtgtttaggaaaagaaacttaacaataatggacctacatccaggatcggggaaaacaagaagatatcttccagccatagtccgtgaggccataagaaggaacgtgcgcacactaattttggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttaccgatccagccagcatagcgcgcagagggtacatctcaacccgagtgggcatgggtgaagcagctgcgatcttcatgacagccactcccccaggatcggtggaggcctttccacagagcaatgcagttatccaagatgaggaaagagacattcctgagagatcatggaactcaggctatgagtggatcactgacttcccaggtaaaacagtctggtttgttccaagcatcaaatcaggaaatgacattgccaactgcttaagaaagaatgggaaacgggtgattcaattgagcaggaaaacctttgatacagagtaccaaaaaacaaaaaacaacgactgggactatgtcgtcacaacagatatctccgaaatgggagcaaacttccgagccgacagggtgatagacccaagacggtgtctgaaaccggtaatactaaaagatggtccagagcgcgtcattctagccggaccgatgccagtgactgtggccagtgctgcccagaggagaggaagaattggaaggaaccaaaacaaagaaggtgatcagtacgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaagaaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatgtggacaaaagaaggagaacgaaagaaactacgaccccgctggctggatgccagaacatactcagacccactggccctgcgcgagtttaaagagtttgcagcaggaagaagaagtgtctcaggtgatctaatattagaaatagggaaacttccacaacacttgacgcaaagggcccagaatgccttggacaacctggttatgttgcacaactccgaacaaggaggaagagcctacagacatgcaatggaagaacttccagacaccatagaaacgttgatgctcctagctttgatagctgtgttaactggtggagtgacgctgttcttcctatcaggaaagggcctagggaaaacatctattggcctactctgcgtgatggcttcaagcgtactgctatggatggccagcgtggagcctcattggatagcggcctccatcatactagagtttttcctgatggtgctgcttattccagagccagacagacagcgcactccacaggacaaccagttagcatatgtggtgataggtttgttattcatgatactcacagtggcagccaatgagatgggattattggaaaccacaaagaaagacttagggattggccatgtagccgccgaaaaccaccaccatgctacaatgctggacgtagacctacgtccagcttcagcctggaccctctatgcagtagccacaacagttatcacccccatgatgagacacacaattgaaaatacaacggcaaatatttccctgacagccattgcaaaccaggcagctatattgatgggacttgataaaggatggccaatatcgaagatggacataggagttccacttctcgccttggggtgctattcccaggtgaatccactgacgctgacagcggcggtattgatgctagtggctcattacgccataattggacctggactgcaagcaaaagcgactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgtgaatccatcacactggccactggacctctgaccacgctttgggagggatctccaggaaaattttggaacaccacgatagcggtttccatggcaaacattttcaggggaagttatctagcaggagcaggcctggccttctcattaatgaaatctctaggaggaggtaggagaggtacgggagccaaggggaaacactgggagagaaatggaaaagacagactgaaccaactgagcaagtcagaattcaacacttacaaaaggagtgggattatggaagtggacagatccgaagccaaagagggactgaaaagaggagaaacaaccaaacatgcagtgtcgagaggaaccgccaaattgaggtggttcgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaggaaccaatcccaatggcgacctatggatggaacctagtaaagctatactccgggaaagacgtattctttacaccacctgagaagtgtgacacccttttgtgtgatattggtgagtcctctccaaacccaactatagaagaaggaagaacgttacgcgtcctaaagatggtggaaccatggctcagagggaaccaattttgcataaaaattctaaatccctacatgccaagtgtggtggaaactctggagcaaatgcaaagaaaacatggaggaatgctagtgcggaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacttaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgccatccccatggtcacacaaatagccatgactgacaccacaccctttggacaacagagggtgtttaaagagaaagttgacacgcgcacaccaaaagcaaaacgaggcacagcacaaatcatggaggtgacagccaggtggttatggggttttctctctagaaacaaaaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagtagagagaattcactcagtggagtggaaggagaaggactccacaaactcggatatatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtaagggtacagagaccagcgaaaaatggaaccgtgatggatgtcatatccagacgtgaccagagaggaagtggccaggtcggaacttatggcttaaacactttcactaacatggaagcccagctaataagacaaatggagtctgagggaatcttttcacccagcgaattggagaccccaaatttagccgagagagttctcgactggctggaaaaatatggcgtcgaaaggctgaaaagaatggcaatcagcggagatgactgcgtggtgaaaccaattgatgacaggttcgcaacagccttaacagctctgaatgatatgggaaaagtaagaaaagatataccacaatgggaaccctcaaaaggatggaatgattggcaacaggtgcctttttgttcacaccatttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagctgctaatgctatctgttcagccgttccagttgattgggtcccaaccagccgcaccacttggtcgatccatgcccatcaccaatggatgacaacagaagacatgttgtcagtgtggaatagggtttggatagaggaaaacccatggatggaggacaaaacccatgtatccagttgggaagatgttccatatttaggaaaaagggaagatcagtggtgtggatccctgataggcttaacagcaagggctacctgggccaccaacatacaagtggccataaaccaagtgagaagactaatcgggaatgagaattatctagattacatgacatcaatgaagagattcaagaacgagagtgatccgaaggggcactctggtgagtcaacacacttacaaaataaaggaaaataa

SEQ ID NO: 19 - DNA, 10179 bp, Dengue virus; identical to SEQ ID NO: 1

SEQ ID NO: 20 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaattggtgatggcttttatagcattcctaagatttctagccatacctccaacagcaggaattttggctagatggggctcattcaagaagaatggagcgatcaaagtgttacggggtttcaagaaagaaatctcaaacatgttgaacataatgaacaggaggaaaagatctgtgaccatgctcctcatgctgctgcccacagccctggcgttccatctgaccacccgagggggagagccgcacatgatagttagcaagcaggaaagaggaaaatcacttttgtttaagacctctgcaggtgtcaacatgtgcacccttattgcaatggatttgggagagttatgtgaggacacaatgacctacaaatgcccccggatcactgagacggaaccagatgacgttgactgttggtgcaatgccacggagacatgggtgacctatggaacatgttctcaaactggtgaacaccgacgagacaaacgttccgtcgcactggcaccacacgtagggcttggtctagaaacaagaaccgaaacgtggatgtcctctgaaggcgcttggaaacaaatacaaaaagtggagacctgggctctgagacacccaggattcacggtgatagccctttttctagcacatgccataggaacatccatcacccagaaagggattatttttattttgctgatgctggtaactccatccatggccatgcggtgcgtgggaataggcaacagagacttcgtggaaggactgtcaggagctacgtgggtggatgtggtactggagcatggaagttgcgtcactaccatggcaaaagacaaaccaacactggacattaaactcttgaagacggaggtcacaaaccctgccgtcctgcgcaaactgtgcattgaagctaaaatatcaaacaccaccaccgattcgagatgtccaacacaaggagaagccacgctggtggaagaacaggacacgaactttgtgtgtcgacgaacgttcgtggacagaggctggggcaatggttgtgggctattcggaaaaggtagcttaataacgtgtgctaagtttaagtgtgtgacaaaactggaaggaaagatagtccaatatgaaaacttaaaatattcagtgatagtcaccgtacacactggagaccagcaccaagttggaaatgagaccatagaacatggaacaactgcaaccataacacctcaagctcccacgtcggaaatacagctgacagactacggagctctaacattggattgttcacctagaacagggctagactttaatgagatggtgttgttgacaatgaaaaaaaaatcatggctcgtccacaaacaatggtttctagacttaccactgccttggacctcgggggcttcaacatcccaagagacttggaatagacaagacttgctggtcacatttaagacagctcatgcaaaaaagcaggaagtagtcgtactaggatcacaagaaggagcaatgcacactgcgtcgactggagcgacagaaatccaaacgtctggaacgacaacaatttttgcaggacacctgaaatgcagattaaaaatggataaactgattttaaaagggatgtcatatgtaatgtgcacagggtcattcaagttagagaaggaagtggctgagacccagcatggaactgttctagtgcaggttaaatacgaaggaacagatgcaccatgcaagatccccttctcgtcccaagatgagaagggagtaacccagaatgggagattgataacagccaaccccatagtcactgacaaagaaaaaccagtcgacattgaagcggagccaccttttggtgagagctacattgtggtaggagcaggtgaaaaagctttgaaactaagctggttcaagaagggaagcagtatagggaaaatgtttgaagcaactgcccgtggagcacgaaggatggccatcctgggagacactgcatgggacttcggttctataggaggggtgttcacgtctgtgggaaaactgatacaccagatttttgggactgcgtatggagttttgttcagcggtgtttcttggaccatgaagataggaatagggattctgctgacatggctaggattaaactcaaggagcacgtccttttcaatgacgtgtatcgcagttggcatggtcacactgtacctaggagtcatggttcaggcggactcgggatgtgtaatcaactggaaaggcagagaactcaaatgtggaagcggcatttttgtcaccaatgaagtccacacctggacagagcaatataaattccaggccgactcccctaagagactatcagcggccattgggaaggcatgggaggagggtgtgtgtggaattcgatcagccactcgtctcgagaacatcatgtggaagcaaatatcaaatgaattaaaccacatcttacttgaaaatgacatgaaatttacagtggtcgtaggagacgttagtggaatcttggcccaaggaaagaaaatgattaggccacaacccatggaacacaaatactcgtggaaaagctggggaaaagccaaaatcataggagcagatgtacagaataccaccttcatcatcgacggcccaaacaccccagaatgccctgataaccaaagagcatggaacatttgggaagttgaagactatggatttggaattttcacgacaaacatatggttgaaattgcgtgactcctacactcaagtgtgtgaccaccggctaatgtcagctgccatcaaggatagcaaagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagatatatggaggaccaatatctcagcacaactacagaccaggatatttcacacaaacagcagggccgtggcacttgggcaagttagaactagattttgatttatgtgaaggtaccactgttgttgtggatgaacattgtggaaatcgaggaccatctcttagaaccacaacagtcacaggaaagacaatccatgaatggtgctgtagatcttgcacgttaccccccctacgtttcaaaggagaagacgggtgctggtacggcatggaaatcagaccagccaaggagaaggaagagaacctagttaagtcaatggtctctgcagggtcaggagaagtggacagtttttcactaggactgctatgcatatcaataatgatcgaagaggtaatgagatccagatggagcaggaaaatgctgatgattggaacattggctgtgttcctccttctcacaatgggacaattgacatggaatgatctgatcaggctatgtatcatggttggagccaacgcttcagacaagatggggatgggaacaacgtacctagctttgatggccactttcagaatgagaccaatgttcgcagtcgggctactgtttcgcagattaacatctagagaagttcttcttcttacagttggattgagtctggtggcatctgtagaactaccaaattccttagaggagctaggggatggacttgcaatgggcatcatgatgttgaaattactgactgattttcagtcacatcagctatgggctaccttgctgtctttaacatttgtcaaaacaactttttcactgcactatgcatggaagacaatggctatgatactgtcaattgtatctctcttccctttatgcctgtccacgacttctcaaaaaacaacatggcttccggtgttgctgggatctcttggatgcaaaccactaaccatgtttcttataacagaaaacaaaatctggggaaggaaaagctggcctctcaatgaaggaattatggctgttgggatagttagcattcttctaagttcacttctcaagaatgatgtgccactagctggcccactaatagctggaggcatgctaatagcatgttatgtcatatctggaagctcggccgatttatcactggagaaagcggctgaggtctcctgggaagaagaagcagaacactctggtgcctcacacaacatactagtggaggtccaagatgatggaaccatgaagataaaggatgaagagagagatgacacactcaccattctcctcaaagcaactctgctagcaatctcaggggtatacccaatgtcaataccggcgaccctctttgtgtggtatttttggcagaaaaagaaacagagatcaggagtgctatgggacacacccagccctccagaagtggaaagagcagtccttgatgatggcatttatagaattctccaaagaggattgttgggcaggtctcaagtaggagtaggagtttttcaagaaggcgtgttccacacaatgtggcacgtcaccaggggagctgtcctcatgtaccaagggaagagactggaaccaagttgggccagtgtcaaaaaagacttgatctcatatggaggaggttggaggtttcaaggatcctggaacgcgggagaagaagtgcaggtgattgctgttgaaccggggaagaaccccaaaaatgtacagacagcgccgggtaccttcaagacccctgaaggcgaagttggagccatagctctagactttaaacccggcacatctggatctcctatcgtgaacagagagggaaaaatagtaggtctttatggaaatggagtggtgacaacaagtggtacctacgtcagtgccatagctcaagctaaagcatcacaagaagggcctctaccagagattgaggacgaggtgtttaggaaaagaaagttaacaataatggacctacatccaggatcgggaaaaacaagaagataccttccagccatagtccgtgaggccataaaaagaaagctgcgcacgctagtcttagctcccacaagagttgtcgcttctgaaatggcagaggcgctcaagggaatgccaataaggtatcagacaacagcagtgaagagtgaacacacgggaaaggagatagttgaccttatgtgtcatgccactttcactatgcgtctcctgtctcctgtgagagttcccaattataatatgattatcatggatgaagcacatttcaccgatccagccagcatagcagccagagggtatatctcaacccgagtgggtatgggtgaagcagctgcgattttcatgacagccactccccccggatcggtggaggcctttccacagagcaatgcagttatccaagatgaggaaagagacattcctgaaagatcatggaactcaggctatgactggatcactggtttcccaggtaaaacagtctggtttgttccaagcatcaaatcaggaaatgacattgccaactgtttaagaaagaatgggaaacgggtggtccaattgagcagaaaaacttttgacactgagtaccagaaaacaaaaaataacgactgggactatgttgtcacaacagacatatccgaaatgggagcgaacttccgagccgacagggtaatagacccgaggcggtgcctgaaaccggtaatactaaaagatggcccagagcgtgtcattctagccggaccgatgccagtgactgtggctagcgccgcccagaggagaggaagaattggaaggaaccaaaataaggaaggcgatcagtatatttacatgggacagcctctaaacaatgatgaggaccacgcccattggacagaagcaaaaatgctccttgacaacataaacacaccagaagggattatcccagccctctttgagccggagagagaaaagagtgcagcaatagacggggaatacagactacggggtgaagcgaggaaaacgttcgtggagctcatgagaagaggagatctacctgtctggctatcctacaaagttgcctcagaaggcttccagtactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaatgccttggacaatctggttatgttgcacaactctgaacaaggaggaaaagcctatagacacgccatggaagaactaccagacaccatagaaacgttaatgctcctagctttgatagctgtgctgactggcggagtgacgttgttcttcctatcaggaaggggtctaggaaaaacatccattggcctactctgcgtgattgcctcaagtgcactgttatggatggccagtgtggaaccccattggatagcggcctctatcatactggagttctttctgatggtgttgcttattccagagccggacagacagcgcactccacaagacaaccagctagcatacgtggtgataggtctgttattcatgatattgacagtggcagccaatgagatgggattactggaaaccacaaagaaggacctggggattggtcatgcagctgctgaaaaccaccatcatgctgcaatgctggacgtagacctacatccagcttcagcctggactctctatgcagtggccacaacaattatcactcccatgatgagacacacaattgaaaacacaacggcaaatatctccctgacagctattgcaaaccaggcagctatattgatgggacttgacaagggatggccaatatcaaagatggacataggagttccacttctcgccttggggtgctattctcaggtgaacccgctgacgctgacagcggcggtattgatgctagtggctcattatgccataattggacccggactgcaagcaaaagctactagagaagctcaaaaaaggacagcagccggaataatgaaaaacccaactgtcgacgggatcgttgcaatagatttggaccctgtggtttacgatgcaaaatttgaaaaacagctaggccaaataatgttgttgatactttgcacatcacagatcctcctgatgcggaccacatgggccttgtgtgaatccatcacactagccactggacctctgactacgctttgggagggatctccaggaaaattctggaacaccacgatagcggtgtccatggcaaacatttttaggggaagttatctagcaggagcaggtctggccttttcattaatgaaatctctaggaggaggtaggagaggcacgggagcccaaggggaaacactgggagaaaaatggaaaagacagctaaaccaattgagcaagtcagaattcaacacttacaaaaggagtgggattatagaggtggatagatctgaagccaaagaggggttaaaaagaggagaaacgactaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacgaaaggaggacctggacatgaggaaccaatcccaatggcaacctatggatggaacctagtaaagctatactccgggaaagatgtattctttacaccacctgagaaacgtgacaccctcttgtgtgatattggtgagtcctctccgaacccaactatagaagaaggaagaacgttacgtgttctaaagatggtggaaccatggctcagaggaaaccaattttgcataaaaattctaaatccctatatgccgagtgtggtagaaactttggagcaaatgcaaagaaaacatggaggaatgctagtgcgaaatccactctcaagaaactccactcatgaaatgtactgggtttcatgtggaacaggaaacattgtgtcagcagtaaacatgacatctagaatgctgctaaatcgattcacaatggctcacaggaagccaacatatgaaagagacgtggacttaggcgctggaacaagacatgtggcagtagaaccagaggtggccaacctagatatcattggccagaggatagagaatataaaaaatgaacacaaatcaacatggcattatgatgaggacaatccatacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacagagggtgtttaaagagaaagttgacacgcgtacaccaaaagcgaaacgaggcacagcacaaattatggaggtgacagccaggtggttatggggttttctctctagaaacaaaaaacccagaatctgcacaagagaggagttcacaagaaaagtcaggtcaaacgcagctattggagcagtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaattaggagagttcggaaaggcaaaaggaagtcgcgcaatatggtacgtgtggttgggagcgcgctttttagagtttgaagcccttggtttcatgaatgaagatcactggttcagcagagagaattcactcagtggagtggaaggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctattggccacgtcaatctttaagctaacctaccaaaacaaggtagtaagggtgcagagaccagcgaaaaatggaaccgtgatggatgtcatatccagacgtgaccagagaggaagtggacaggttggaacctatggcttaaacaccttcaccaacatggaggcccaactaataagacaaatggagtctgagggaatcttttcacccagcgaattggaaaccccaaatctagccgaaagagtcctcgactggttgaaaaaacatggcaccgagaggctgaaaagaatggcaatcagtggagatgactgtgtggtgaaaccaattgatgacagatttgcaacagccttaacagctttgaatgacatgggaaaggtaagaaaagacataccgcaatgggaaccttcaaaaggatggaatgattggcaacaagtgcctttctgttcacaccatttccaccagctgattatgaaggatgggagggagatagtggtgccatgccgcaaccaagatgaacttgtaggtagggccagagtatcacaaggcgccggatggagcttgagagaaactgcatgcctaggcaagtcatatgcacaaatgtggcagctgatgtacttccacaggagagacttgagattagcggctaatgctatctgttcagccgttccagttgattgggtcccaaccagccgcaccacctggtcgatccatgcccaccatcaatggatgacaacagaagacatgttgtcagtgtggaatagggtttggatagaggaaaacccatggatggaggacaagactcatgtgtccagttgggaagacgttccatacctaggaaaaagggaagatcaatggtgtggttccctaataggcttaacagcacgagccacctgggccaccaacatacaagtggccataaaccaagtgagaaggctcattgggaatgagaattatctagacttcatgacatcaatgaagagattcaaaaacgagagtgatcccgaaggggcactctggtaa

SEQ ID NO: 21 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaattggtgatggcttttatagcattcctaagatttctagccatacctccaacagcaggaattttggctagatggggctcattcaagaagaatggagcgatcaaagtgttacggggtttcaagaaagaaatctcaaacatgttgaacataatgaacaggaggaaaagatctgtgaccatgctcctcatgctgctgcccacagccctggcgttccatctgaccacccgagggggagagccgcacatgatagttagcaagcaggaaagaggaaaatcacttttgtttaagacctctgcaggtgtcaacatgtgcacccttattgcaatggatttgggagagttatgtgaggacacaatgacctacaaatgcccccggatcactgagacggaaccagatgacgttgactgttggtgcaatgccacggagacatgggtgacctatggaacatgttctcaaactggtgaacaccgacgagacaaacgttccgtcgcactggcaccacacgtagggcttggtctagaaacaagaaccgaaacgtggatgtcctctgaaggcgcttggaaacaaatacaaaaagtggagacctgggctctgagacacccaggattcacggtgatagccctttttctagcacatgccataggaacatccatcacccagaaagggatcatttttattttgctgatgctggtaactccatccatggccatgcggtgcgtgggaataggcaacagagacttcgtggaaggactgtcaggagctacgtgggtggatgtggtactggagcatggaagttgcgtcactaccatggcaaaagacaaaccaacactggacattgaactcttgaagacggaggtcacaaaccctgccgtcctgcgcaaactgtgcattgaagctaaaatatcaaacaccaccaccgattcgagatgtccaacacaaggagaagccacgctggtggaagaacaggacacgaactttgtgtgtcgacgaacgttcgtggacagaggctggggcaatggttgtgggctattcggaaaaggtagcttaataacgtgtgctaagtttaagtgtgtgacaaaactggaaggaaagatagtccaatatgaaaacttaaaatattcagtgatagtcaccgtacacactggagaccagcaccaagttggaaatgagaccacagaacatggaacaactgcaaccataacacctcaagctcccacgtcggaaatacagctgacagactacggagctctaacattggattgttcacctagaacagggctagactttaatgagatggtgttgttgacaatggaaaaaaaatcatggctcgtccacaaacaatggtttctagacttaccactgccttggacctcgggggcttcaacatcccaagagacttggaatagacaagacttgctggtcacatttaagacagctcatgcaaaaaagcaggaagtagtcgtactaggatcacaagaaggagcaatgcacactgcgttgactggagcgacagaaatccaaacgtctggaacgacaacaatttttgcaggacacctgaaatgcagactaaaaatggataaactgactttaaaagggatgtcatatgtaatgtgcacagggtcattcaagttagagaaggaagtggctgagacccagcatggaactgttctagtgcaggttaaatacgaaggaacagatgcaccatgcaagatccccttctcgtcccaagatgagaagggagtaacccagaatgggagattgataacagccaaccccatagtcactgacaaagaaaaaccagtcaacattgaagcggagccaccttttggtgagagctacattgtggtaggagcaggtgaaaaagctttgaaactaagctggttcaagaagggaagcagtatagggaaaatgtttgaagcaactgcccgtggagcacgaaggatggccatcctgggagacactgcatgggacttcggttctataggaggggtgttcacgtctgtgggaaaactgatacaccagatttttgggactgcgtatggagttttgttcagcggtgtttcttggaccatgaagataggaatagggattctgctgacatggctaggattaaactcaaggagcacgtccctttcaatgacgtgtatcgcagttggcatggtcacgctgtacctaggagtcatggttcaggcggactcgggatgtgtaatcaactggaaaggcagagaactcaaatgtggaagcggcatttttgtcaccaatgaagtccacacctggacagagcaatataaattccaggccgactcccctaagagactatcagcggccattgggaaggcatgggaggagggtgtgtgtggaattcgatcagccactcgtctcgagaacatcatgtggaagcaaatatcaaatgaattaaaccacatcttacttgaaaatgacatgaaatttacagtggtcgtaggagacgttagtggaatcttggcccaaggaaagaaaatgattaggccacaacccatggaacacaaatactcgtggaaaagctggggaaaagccaaaatcataggagcagatgtacagaataccaccttcatcatcgacggcccaaacaccccagaatgccctgataaccaaagagcatggaacatttgggaagttgaagactatggatttggaattttcacgacaaacatatggttgaaattgcgtgactcctacactcaagtgtgtgaccaccggctaatgtcagctgccatcaaggatagcaaagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagatatatggaggaccaatatctcagcacaactacagaccaggatatttcacacaaacagcagggccgtggcacttgggcaagttagaactagattttgatttatgtgaaggtaccactgttgttgtggatgaacattgtggaaatcgaggaccatctcttagaaccacaacagtcacaggaaagacaatccatgaatggtgctgtagatcttgcacgttaccccccctacgtttcaaaggagaagacgggtgctggtacggcatggaaatcagaccagtcaaggagaaggaagagaacctagttaagtcaatggtctctgcagggtcaggagaagtggacagtttttcactaggactgctatgcatatcaataatgatcgaagaggtaatgagatccagatggagcagaaaaatgctgatgactggaacattggctgtgttcctccttctcacaatgggacaattgacatggaatgatctgatcaggctatgtatcatggttggagccaacgcttcagacaagatggggatgggaacaacgtacctagctttgatggccactttcagaatgagaccaatgttcgcagtcgggctactgtttcgcagattaacatctagagaagttcttcttcttacagttggattgagtctggtggcatctgtagaactaccaaattccttagaggagctaggggatggacttgcaatgggcatcatgatgttgaaattactgactgattttcagtcacatcagctatgggctaccttgctgtctttaacatttgtcaaaacaactttttcattgcactatgcatggaagacaatggctatgatactgtcaattgtatctctcttccctttatgcctgtccacgacttctcaaaaaacaacatggcttccggtgttgctgggatctcttggatgcaaaccactaaccatgtttcttataacagaaaacaaaatctggggaaggaaaagctggcctctcaatgaaggaattatggctgttggaatagttagcattcttctaagttcacttctcaagaatgatgtgccactagctggcccactaatagctggaggcatgctaatagcatgttatgtcatatctggaagctcggccgatttatcactggagaaagcggctgaggtctcctgggaagaagaagcagaacactctggtgcctcacacaacatactagtggaggtccaagatgatggaaccatgaagataaaggatgaagagagagatgacacactcaccattctcctcaaagcaactctgctagcaatctcaggggtatacccaatgtcaataccggcgaccctctttgtgtggtatttttggcagaaaaagaaacagagatcaggagtgctatgggacacacccagccctccagaagtggaaagagcagtccttgatgatggcatttatagaattctccaaagaggattgttgggcaggtctcaagtaggagtaggagtttttcaagaaggcgtgttccacacaatgtggcacgtcaccaggggagctgtcctcatgtaccaagggaagagactggaaccaagttgggccagtgtcaaaaaagacttgatctcatatggaggaggttggaggtttcaaggatcctggaacgcgggagaagaagtgcaggtgattgctgttgaaccggggaagaaccccaaaaatgtacagacagcgccgggtaccttcaagacccctgaaggcgaagttggagccatagctctagactttaaacccggcacatctggatctcctatcgtgaacagagagggaaaaatagtaggtctttatggaaatggagtggtgacaacaagtggtacctacgtcagcgccatagctcaagctaaagcatcacaagaagggcctctaccagagattgaggacgaggtgtttaggaaaagaaacttaacaataatggacctacatccaggatcggggaaaacaagaagatatcttccagccatagtccgtgaggccataagaaggaacgtgcgcacgctagtcttagctcccacaagagttgtcgcttctgaaatggcagaggcgctcaagggaatgccaataaggtatcagacaacagcagtgaagagtgaacacacaggaaaagagatagttgaccttatgtgtcacgccactttcactatgcgtctcctgtctcctgtgagagttcccaattataatatgattatcatggatgaagcacattttaccgatccagccagcatagcagccagagggtatatctcaacccgagtgggtatgggtgaagcagctgcgattttcatgacagccactccccccggatcggtggaggcctttccacagagcaatgcagttatccaagatgaggaaagagacattcctgaaagatcatggaactcaggctatgactggatcactgatttcccaggtaaaacagtctggtttgttccaagcatcaaatcaggaaatgacattgccaactgtttaagaaagaatgggaaacgggtggtccaattgagcagaaaaacttttgacactgagtaccagaaaacaaaaaataacgactgggactatgttgtcacaacagacatatccgaaatgggagcaaacttccgagccgacagggtaatagacccgaggcggtgcctgaaaccggtaatactaaaagatggcccagagcgtgtcattctagccggaccgatgccagtgactgtggctagcgccgcccagaggagaggaagaattggaaggaaccaaaataaggaaggcgatcagtatatttacatgggacagcctctaaacaatgatgaggaccacgcccattggacagaagcaaaaatgctccttgacaacataaacacaccagaagggattatcccagccctctttgagccggagagagaaaagagtgcagcaatagacggggaatacagactacggggtgaagcgaggaaaacgttcgtggagctcatgagaagaggagatctacctgtctggctatcctacaaagttgcctcagaaggcttccagtactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaacgccttggacaatctggttatgttgcacaactctgaacaaggaggaaaagcctatagacacgccatggaagaactaccagacaccatagaaacgttaatgctcctagctttgatagctgtgctgactggtggagtgacgttgttcttcctatcaggaaggggtctaggaaaaacatccattggcctactctgcgtgattgcctcaagcgcactgctatggatggccagtgtggaaccccattggatagcggcctctatcatactggagttctttctgatggtgttgcttattccagagccggacagacagcgcactccacaagacaaccagctagcatacgtggtgataggtctgttattcatgatattgacagcggcagccaatgagatgggattactggaaaccacaaagaaggacctggggattggtcatgcagctgctgaaaaccaccatcatgctgcaatgctggacgtagacctacatccagcttcagcctggactctctatgcagtggccacaacaattatcactcccatgatgagacacacaattgaaaacacaacggcaaatatttccctgacagctattgcaaaccaggcagctatattgatgggacttgacaagggatggccaatatcaaagatggacataggagttccacttctcgccttggggtgctattctcaggtgaacccgctgacgctgacagcggcggtatttatgctagtggctcattatgccataattggacccggactgcaagcaaaagctactagagaagctcaaaaaaggacagcagccggaataatgaaaaacccaactgtcgacgggatcgttgcaatagatttggaccctgtggtttacgatgcaaaatttgaaaaacagctaggccaaataatgttgttgatactttgcacatcacagatcctcctgatgcggaccacatgggccttgtgtgaatccatcacactagccactggacctctgactacgctttgggagggatctccaggaaaattctggaacaccacgatagcggtgtccatggcaaacatttttaggggaagttatctagcaggagcaggtctggccttttcattaatgaaatctctaggaggaggtaggagaggcacgggagcccaaggggaaacactgggagaaaaatggaaaagacagctaaaccaattgagcaagtcagaattcaacacttacaaaaggagtgggattatagaggtggatagatctgaagccaaagaggggttaaaaagaggagaaccgactaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacgaaaggaggacctggacatgaggaaccaatcccaatggcaacctatggatggaacctagtaaagctatactccgggaaagatgtattctttacaccacctgagaaatgtgacaccctcttgtgtgatattggtgagtcctctccgaacccaactatagaagaaggaagaacgttacgtgttctaaagatggtggaaccatggctcagaggaaaccaattttgcataaaaattctaaatccctatatgccgagtgtggtagaaactttggagcaaatgcaaagaaaacatggaggaatgctagtgcgaaatccactctcaagaaactccactcatgaaatgtactgggtttcatgtggaacaggaaacattgtgtcagcagtaaacatgacatctagaatgttgctaaatcgattcacaatggctcacaggaagccaacatatgaaagagacgtggacttaggcgctggaacaagacatgtggcagtagaaccagaggtggccaacctagatatcattggccagaggatagagaatataaaaaatggacacaaatcaacatggcactatgatgaggacaatccatacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacagagggtgtttaaagagaaagttgacacgcgtacaccaaaagcgaaacgaggcacagcacaaattatggaggtgacagccaggtggttatggggttttctctctagaaacaaaaaacccagaatctgcacaagagaggagttcacaagaaaagtcaggtcaaacgcagctattggagcagtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaattaggagagttcggaaaggcaaaaggaagtcgcgcaatatggtacatgtggttgggagcgcgctttttagagtttgaagcccttggtttcatgaatgaagatcactggttcagcagagagaattcactcagtggagtggaaggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctattggccacgtcaatctttaagctaacctaccaaaacaaggtagtaagggtgcagagaccagcgaaaaatggaaccgtgatggatgtcatatccagacgtgaccagagaggaagtggacaggttggaacctatggcttaaacaccttcaccaacatggaggcccaactaataagacaaatggagtctgagggaatcttttcacccagcgaattggaaaccccaaatctagccgaaagagtcctcgactggttgaaaaaacatggcaccgagaggctgaaaagaatggcaatcagtggagatgactgtgtggtgaaaccaatcgatgacagatttgcaacagccttaacagctttgaatgacatgggaaaggtaagaaaagacataccgcaatgggaaccttcaaaaggatggaatgattggcaacaagtgcctttctgttcacaccatttccaccagctgattatgaaggatgggagggagatagtggtgccatgccgcaaccaagatgaacttgtaggtagggccagagtatcacaaggcgccggatggagcttgagagaaactgcatgcctaggcaagtcatatgcacaaatgtggcagctgatgtacttccacaggagagacttgagattagcggctaatgctatctgttcagccgttccagttgattgggtcccaaccagccgtaccacctggtcgatccatgcccaccatcaatggatgacaacagaagacatgttgtcagtgtggaatagggtttggatagaggaaaacccatggatggaggacaagactcatgtgtccagttgggaagacgttccatacctaggaaaaagggaagatcgatggtgtggatccctaataggcttaacagcacgagccacctgggccaccaacatacaagtggccataaaccaagtgagaaggctcattgggaatgagaattatctagacttcatgacatcaatgaagagattcaaaaacgagagtgatcccgaaggggcactctggtaa

SEQ ID NO: 22 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagagagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacattatgtggaagcaaatatcaaatgaattgaaccacatcttacttgaaaatgacatgaaattcacagtggttgtaggagatgttgctgggatcttggctcaaggaaaaaaaatgattaggccacaacccatggaatacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaagtgtgtgaccaccggctaatgtcagctgccattaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggcaccacagttgttgtggatgaacattgtggaaatcgaggaccatctcttaggaccacaacagtcacaggaaaaataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagccctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccaaaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtagagccccattggatagcggcctctatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggacaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaatcaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagtttggaaaggcaaaaggaagtcgtgcaatatggtacatgtggttgggagcgcgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcgtttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 23 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaactggtgatggcttttatagcattcctaagatttctagccatacctccaacagcaggaattttggctagatggggctcattcaagaagaatggggcgatcaaagtgttacggggtttcaagaaagaaatctcaaacatgttaaacataatgaacaggagaaaaagatctgtgaccatgctcttcatgctgctgcccacagccctggcgttccatctgaccacccgagggggagagccgcacatgatagttagcaagcaggaaagaggaaagtcacttttgtttaagacctctgcaggtgtcaacatgtgtacccttattgcaatggatttgggagagttgtgtgaggacacaatgacctacaaatgcccccggatcactgaaacagaaccagatgacgttgactgttggtgcaacgccacggagacatgggtgacttatggaacatgttctcaaactggtgaacaccgacgagacaaacgttctgttgcactggcaccacacgtagggcttggtctagaaacaagaaccgaaacgtggatgtcctctgaaggcgcttggagacaaatacaaaaagtggagacatgggctctgagacacccaggattcacggtgatggctctttttctagcacatgccataggaacatccatcacccagaaaggaattattttcattttgctgatgctggtaactccatccatggccatgcggtgcgtgggaataggtaacagagacttcgtggaaggactgtcaggagctacgtgggtggatgtggtactggagcatggaagttgcgtcactactatggcaaaagacaaaccaacactggatattgaactcttaaagacggaggtcacaaacccagccgtcctgcgcaaactgtgcattgaagccaaaatatcaaataccaccaccgattcgagatgtccaacacaaggagaagccacgctggtggaagaacaagacacgaactttgtgtgtcgacgaacgttcgtggacagaggctggggcaatggttgtgggctatttggaaaaggtagcttaataacgtgtgctaagtttaagtgtgtgacaaaactggaaggaaagatagtccaatatgaaaatttaaaatattcagtgatagtcaccgtccacactggagaccagcaccaagttggaaatgagactacagaacatggaacaactgcaatcataacacctcaagctcctacgtcggaaatacagctgacagactacggagctctaacactggactgttcacctagaacagggctagactttaatgagatggtgttattgacaatgaaagaaaaatcatggctcgttcacaaacaatggtttctagacttaccgctgccttggacctcgggggcttcaacatcccaagagacttggaatagacaagacttgctggtcacatttaagacagctcatgcaaagaagcaggaagtagttgtactaggatcacaagaaggagcgatgcacactgcgctgactggagcaacagaaatccaaacgtctggaacgacaacaattttcgcagggcacctgaaatgcagactgaaaatggataaactgactttaaaaggggtatcatatgtaatgtgcacaggctcattcaagctagaaaaggaagtggctgagacccagcatggaactgttctagtgcaggttaagtacgaaggaacagatgcaccatgtaagatccccttctcatcccaagatgagaagggagtaatccagaatgggagattgataacagccaaccccatagtcactgacaaagaaaaaccagtcaacattgaggcggagccaccttttggcgagagctacatcgtggtaggagcaggtgaaaaagccttgaaactaagctggttcaagaagggaagcagcatagggaaaatgtttgaagcaactgcccgtggagcacgaaggatggccattctgggagacactgcatgggacttcggttctataggaggagtgttcacgtccgtgggaaaactggtacaccagatttttggaactgcgtacggagttttgttcagcggtgtttcttggaccatgaaaataggaatagggattctgctgacatggctaggattaaattcaaggagcacgtccctttcaatgacgtgtatcgcagttggcatggtcacactgtacctaggagtcatggttcaggcggactcgggatgtgtaattaactggaaaggcagagaactcaaatgtggaagcggcatttttgtcactaatgaagttcacacctggacagagcaatacaaattccaggccgactccccaaagagactatcagcagccattgggaaggcatgggaggagggtgtgtgtggaattcgatcagccactcgtctcgaaaacatcatgtggaagcaaatatcaaatgaattaaaccacatcttacttgaaaatgacatgaaattcacagtggtcgtaggagatgtcagtgggatcttggcccaaggaaagaaaatgattaggccacaacccatggaacacaaatactcgtggaaaagctggggaaaagccaagatcataggagcagatgtacagaatatcaccttcatcatcgacggcccaaacacctcagaatgccctgataatcaaagagcatggaacatctgggaagttgaagactatggatttggaattttcacgacaaacatatggttgaaattgcgtgactcttatactcaagtgtgtgaccaccggctaatgtcagctgccattaaggatagcaaagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagatatatggaggaccagtatctcagcacaactacagaccaggatatttcacacaaacagcagggccatggcacttaggcaagttggaactagattttgatttgtgtgaaggtaccacagttgttgtggatgaaaattgtggaaatcgaggaccatctcttagaaccacaacagtcacaggaaagacaatccatgaatggtgctgtagatcttgcacgttaccccccctacgtttcaaaggggaagacgggtgctggtacggcatggaaatcagaccagtcaaggagaaggaagagaacctagttaagtcaatggtctctgcagggtcaggagaagtggatagtttttcactaggactgctatgcatatcaataatgatcgaagaggtaatgagatccagatggagcagaaagatgctgatgactggaacattggctgtgttcctccttctcacaatgggacaattgacatggaatgatctgatcaggctatgtatcatggttggagccaatgcttcagacatgatggggatgggaacaacgtacctagctttgatggctactttcagaatgagaccaatgttcgcagtcgggctcttatttcgcagattaacatctagagaagttcttcttcttacagttggattgagcctggtggcatctgtagaactgccaaattccttagaagagctaggggatggacttgcaatgggcatcatgatgttgaaattactgactgattttcagccacatcagctatgggctaccttgctgtctttaacatttgtcaaaacaactttttcattgcactatgcatggaagacaatggccatgatactatcaattgtgtctctcctccctttgtgcctgtccacgacttctcaaaaaacaacatggcttccggtgctgctgggatctcttggatgcaaaccactaaccatgcttcttataacagaaaacaaaatttgggggaggagaagttggcccctcaatgaaggaattatggctattggaatagttagcatcctactaagttcacttctcaaaaatgatgtgccactagctggcccactaatagctggaggcatgctaatagcatgttatgtcatatctggaagctcggccgacttatcactggagaaagcggctgaggtttcctgggaagatgaagcagaacactctggtgcctcacacaacatactagtggaggtccaagatgacggaaccatgaagataaaagatgaagagagagatgacacactcaccattctcctcaaagcaactctgttagcaatctcaggggtatacccaatgtcaataccggcgaccctctttgtgtggtatttttggcagaaaaagaaacagagatcaggagtgctatgggacacacccagccctccagaagtggaaagagcagtccttgacaatggcatttatagaattctccaaagaggattgttgggcaggtctcaagtaggagtaggagtttttcaagaaggtgtgttccacacaatgtggcacgtcaccaggggagctgttctcatgtaccaagggaagagattggaaccaagttgggctagtgtcaaaagagacttgatctcatatggaggaggttggaggtttcaaggatcctggaacacgggagaagaagtgcaggtgattgctgttgaaccggggaagaaccccaaaaatgtacagacaacgccaggcaccttcaagacccctgaaggtgaagttggagctatagctctagacttcaaacccggcacatctggatctcctatcgtgaacagagagggaaaaatagtgggtctttatggaaatggagtggtgacaacaagtggaacctacgtcagtgccatagctcaagctaaagcatcacaagaagggcccctaccagagattgaggacgaggtgtttaggaaaaggaatttaacaataatggacctacatccaggatcagggaaaacaagaagataccttccagccatagtccgtgaggccataaaaagaaagctgcgcacgctagtcttggcccccacaagagttgtcgcttctgaaatggcagaagcgctcaagggaatgccaataaggtatcagacaacagcagtgaaaagtgaacacacgggaaaggagatagttgatcttatgtgtcacgccactttcactatgcgtctcctgtctcctgtgagagtccccaattataacatgattatcatggatgaagcacatttcaccgatccagccagcatagcagccagagggtacatctcaacccgagtaggtatgggtgaagcagctgcgatcttcatgacagccactccccccggatcggtggaggcctttccacagagcaatgcagttatccaagatgaggaaagagacattcctgaaagatcatggaactcaggctatgaatggatcactgatttcccaggtaaaacagtctggtttgttccaagcatcaaatcaggaaatgacattgccaactgtttaagaaagaatgggaaacgggtggtccaattgagcagaaaaacttttgacactgagtaccagaaaacaaaaaacaacgactgggactatgttgtcacaacagacatatccgaaatgggagcaaacttccgagccgacagggtaatagacccaaggcggtgcctgaaaccggtaatactaaaagatggtccagagcgtgtcatcctagctggaccgatgccagtgactgtggctagtgccgcccagaggagaggaagaattggaaggaacccaaataaggaaggtgatcagtatgtgtacatgggacagcctctaaacaatgatgaggaccacgcccattggacagaagcaaaaatgctccttgacaacataaacacaccagaagggatcattccagccctctttgagccggagagagaaaagagtgcagcaatagacggggaatacagattacggggtgaagcgaggaaaacgttcgtggagctcatgagaagaggagatctacctgtctggctatcctacaaagtcgcctcagaaggcttccagtactccgacagaaggtggtgctttgatggggaaaggaacaaccaggtgttggaggagaacatggacgtggagatttggacaaaagaaggagaaagaaagaaactacgaccccgctggctggatgccagaacatattctgacccactggctctgcgcgaattcaaagagttcgcagcaggaagaagaagtgtctcaggtgacctaatattagaaatagggaaacttccacaacatttaacgcaaaaagctcagaatgctttggataatctggttatgctgcacaactctgaacaaggaggaaaagcctacagacacgccatggaagaactaccagataccatagaaacattaatgctcctagctttgatagctgtgctgactggtggagtgacgttgttcttcctatcaggaagaggtctaggaaaaacatccattggcctactctgtgtgatggcctcaagtgcactgttgtggatggctagtgtggagcctcattggatagcggcctctatcatactggagttctttctgatggtgttgcttattccagagccagaccgacagcgcactccacaagacaaccagctagcatatgtggtgataggtttgttattcatgatattgacagtggcagccaatgagatgggattgttggaaaccacaaagaaagacctggggattggtcatgcagctgctgaaaaccaccaccatgctgcaatgctagacgtggacctacatccagcttcagcctggactctctatgcagtggccacaacaattatcactcccatgatgagacacacaattgaaaacacaacggcaaatatttccctgacagctatcgcaaaccaggcagctatattgatgggacttgacaagggatggccaatatcaaagatggacataggagttccacttctcgccttggggtgctattctcaggtgaacccgctgacgctgacagcggcggtattgatgctagtagctcactatgccataattggacctggactgcaggcaaaagctactagagaagctcaaaaaaggacagcagctggaataatgaaaaacccaactgttgacgggatcgttgcaatagatttggaccctgtagtttacgatgcaaaatttgaaaaacagctaggccaaataatgttgttgatactttgcacatcacagattctcctaatgcggaccacatgggccttgtgtgaatccatcacattggccactggacctctgaccacgctttgggagggatctccaggaaaattctggaacactactatagcggtgtccatggcaaacattttcaggggaagttatctagcaggagcaggtctggccttttcattgatgaaatctctaggaggaggtaggagaggcacaggagcccaaggagaaacgctgggagaaaaatggaaaagacagctaaaccaattgagcaaatcagaatttaacatttacaagaggagtgggattatagaggtggatagatctgaagccaaagaggggttgaaaagaggagaaacaaccaaacatgcagtgtcgagaggaacggccaaattgaggtggtttgtggagaggaaccttgtgaaaccagaagggaaagtcattgacctcggttgtggaagaggtggctggtcatattactgcgctgggctgaagaaagtcacagaagtaaaaggatacacgaaaggaggacctggacatgaggaaccaatcccaatggcaacctatggatggaacctagtaaagctacactccggaaaagatgtattctttacaccacctgagaaatgtgacacccttttgtgtgatatcggtgagtcctctccgaacccaactatagaagaaggaagaacattacgtgttctaaagatggtggaaccatggctcagaggaaatcaattttgcataaaaattctaaatccctacatgccgagcgtggtagaaactctggagaaaatgcaaaggaaacatggaggaatgctagtgcgaaatccactctcaagaaactccactcatgaaatgtactgggtttcatgtggaacaggaaacattgtgtcagcagtaaacatgacatctagaatgctgctaaaccgattcacaatggctcacaggaaaccaacatatgaaagagacgtggacttaggcgctggaacaagacatgtggcagtggaaccagaggtggccaacctagatatcattggccagaggatagagaatataaaaaatgaacacaaatcaacatggcattatgatgaggacaatccatacaaaacatgggcctatcatggatcatatgaggttaagccatcaggatcagcctcatccatggtcaatggtgtggtgagactgctaaccaaaccatgggatgtcattcccatggtcacacaaatagccatgactgacaccacaccctttggacaacagagggtgtttaaagagaaagttgatacgcgcacaccaaaagcgaaacgaggcacagcgcaaattatggaggtaacagccaggtggttatggggttttctctctagaaacaaaaaacccagaatctgcacaagggaggagtttacaagaaaagttaggtcaaacgcagctattggagcagtgttcgttgatgaaaatcaatggaactcagcaaaagaggcagtggaagatgaacggttttgggaccttgtgcacagagagagggagcttcataaacaaggaaaatgtgccacgtgtgtctacaacatgatgggaaagagagagaaaaaattaggagagttcggaaaggcaaaaggaagtcgcgcaatatggtacatgtggttgggagcgcgctttttagagtttgaagcccttggtttcatgaatgaagatcattggttcagcagagagaattcactcagtggagtggaaggagaaggactccacaaacttggatacatactcagagacatatcaaagattccagggggaaatatgtatgcagatgacacagccggatgggacacaagaataacagaggatgatcttcagaatgaggcaaaaatcactgacatcatggaacctgaacatgccctattggctacgtcaatctttaagctaacctaccaaaacaaggtagtaagggtgcagagaccagcaaaaaatggaaccgtgatggatgtcatatccagacgtgaccagagaggaagtggacaggttggaacctatggcttaaacaccttcactaacatggaggcccaactaataagacaaatggagtctgagggaatcttttcacctagcgaattggaaaccccaaacctagctgaaagagtcttcgactggttggaaaaacatggcatcgagaggctgaaaagaatggcaatcagtggagatgactgtgtggtgaaaccaattgatgacagatttgcaacagccttaacagctttgaatgacatgggaaaggtaagaaaagacataccgcaatgggaaccctcaaaaggatggaacgattggcaacaagtgcctttttgttcacaccatttccaccagctgattatgaaggatgggagggagatagtggtgccatgccgcaaccaagatgaacttgtaggtagggccagagtctcacaaggcgccggatggagcttgagagaaactgcatgcctaggcaagtcatatgcacaaatgtggcagctgatgtacttccacaggagagatttgagactagcggctaatgccatctgttcagccgttccagttgactgggtcccaaccagccgcaccacctggtcgatccatgcccaccatcagtggatgacaacagaagacatgttgtcagtgtggaatagggtttggatagaggaaaacccatggatggaggacaaaactcatgtgtccagttgggaagacgttccatacctaggaaaaagggaagatcaatggtgtggatccctaataggcttaacagcacgagccacctgggccaccaacatacaagtggccataaaccaagtgagaaggctcattgggaacgagaactatctagactatatgacatcaatgaagagattcaaaaacgagagtgatcccgaaggagcactctggtaa

SEQ ID NO: 24 - DNA, 10179 bp, Dengue virus
atgaacaaccaacggaaaaagacgggtcgaccgtctttcaatatgctgaaacgcgcgagaaaccgcgtgtcaactgtttcacagttggctaagagattctcaaaaggattgctttcaggccaaggacccatgaaactggtgatggcttttatagcattcctaagatttctagccatacctccaacagcaggaattttggctagatggagctcattcaagaagaatggagcgattaaagtgctacggggtttcaaaagagaaatctcaaacatgctgaacataatgaacaggagaaaaagatctgtgaccatgctcctcatgctgctgcccacagccctgacgttccatctgaccacccgagggggagagccgcacatgatagttagcaagcaggaaagaggaaagtcacttttgtttaagacctctgcaggtgtcaacatgtgtacccttattgcaatggatctgggagaattatgtgaggacacaatgacctacaaatgcccccggatcactgaggcggaaccagatgacgttgactgttggtgcaatgccacggagacatgggtgacctatggaacatgttctcaaactggtgaacaccgacgagacaaacgttccgtcgcactggcaccacacgtagggcttggtctagaaacaagaaccgaaacgtggatgtcctctgaaggcgcttggaaacaaatacaaaaagtggagacatgggctctgagacacccaggattcacggtgatagccctttttctggcacatgccataggaacatccatcacccagaaaggaattattttcattttgctaatgctggtaactccatccatggccatgcggtgcgtgggaataggaaacagagacttcgtggaaggactgtcaggagctacgtgggtggatgtggtactggagcatggaagttgcgtcactaccatggcaaaagacaaaccaacactggacattgaacttttgaagacggaggtcacaaaccctgccgtcctgcgcaaactgtgcattgaagcaaaaatatcaaataccaccactgattcgagatgtccgacacaaggagaagccacgctggtggaagaacaagacacgaactttgtgtgtcgacgaacgttcgtggacagaggctggggcaatggttgtggactattcggaaaaggtagcttaataacgtgcgctaagtttaagtgtgtgacaaaattggaaggaaagatagtccaatacgaaaacctaaaatattcagtgatcgttaccgtccacactggagaccagcaccaagttggaaatgagaccacagaacatggaacaattgcaaccataacacctcaagctcccacatcggaaatacagctgacagactacggagctctaacactggattgctcacctagaacagggctggacttcaatgagatggtgttgttgacaatgaaagaaaaatcatggctcgtccacaaacaatggtttctagacttaccactgccttggacctcaggggcttcaacatcccaagagacttggaatagacaagacttgctggtcacatttaagacagctcatgcaaagaagcaggaagtagttgtactaggatcacaagaaggagcaatgcacactgcgttgactggagcgacagaaatccaaacgtctggaacgacaacaatttttgcaggacacctgaaatgtaggctaaaaatggataaactgactttaaaaggaacatcatatgtaatgtgcacaggcccattcaagttagagaaggaagtggctgagacccagcatggaactgttctagtacaggtcaaatacgaaggaacagatgcaccatgcaagatccccttctcgtcccaagatgagaagggagcaacccagaatggaagattgataacagccaaccccatagtcactgacaaagaaaaaccagtcaacattgaggcggagccaccttttggtgagagctacatcgtggtaggagcaggtgaaaaagctttgaaactgagctggttcaagaagggaagcagtataggaaaaatgtttgaagcaactgcccgtggagcacgaaggatggccattctgggagacaccgcatgggacttcggttctataggaggagtgttcacgtctgtgggaaaactggtacaccagatttttggaactgcgtatggagttttgttcagcggtgtttcttggactatgaaaataggaatagggattctgctgacatggctaggattaaactcaaggagtacgtctctttcaatgacgtgtatcgcagttggcatggtcacactgtacctaggagtcatggtccaggcggactcgggatgtgtaatcaattggaaaggcagagaactcaaatgtggaagcggcatttttgtcaccaatgaagttcacacctggacagagcaatacaaattccaggccgactccccaaagagactatcagcagccattgggaaggcatgggaggagggtgtgtgtggaattcgatcagccactcgtctcgagaacatcatgtggaagcaaatatcaaatgaactaaaccacatcttacttgaaaatgacatgaaatttacagtggtcgtaggagacgttagtggaatcttggcccaaggaaagaaaatgattaggccacaacccatggaacacaaatactcgtggaaaagctggggaaaagccaaaatcataggagcagatgtacagaacactaccttcatcattgacggcccaaacaccccagaatgccctgataaccaaagagcatggaacatctgggaagttgaagactatggatttggaatcttcacgacaaacatatggttgaaattgcgtgactcctacacccaagtgtgtgaccaccgactaatgtcagctgccatcaaggatagcaaagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagttgttgtggatgaacattgtggaaatcgaggaccatcccttagaaccacaacagtcacaggaaagataatccatgaatggtgctgtagatcttgcacgttaccccccctacgcttcaaaggagaagacgggtgctggtacggcatggaaatcagaccagtcaaggagaaggaagagaacttagttaagtcaatggtctctgcagggtcaggagaagtggacagtttttcactaggactgttatgcatatcaataatgatcgaagaggtaatgagatccagatggagcaggaaaatgctgatgactggaacattagctgtgttcctccttctcacaatgggacaattgacatggaatgatctgatcaggctatgtatcatggttggagccaatgcttcagacaagatggggatgggaacaacgtacttggctttgatggccacattcagaatgagaccaatgttcgcagtcgggctattatttcgcagattaacatctagagaagttctccttctcacagttggattgagtctggtggcatgtgtagaactaccaaattccttagaggagctaggggatggacttgcaatgggcatcatgatgttaaaattactgactgattttcaatcacatcagctatgggctaccttgctgtctttaacatttgtcaaaacaaccttttcattgcactatgcatggaagacaatggctatgatactatcaattgtatctctcttccctttgtgcctgtccacgacttcccaaaaaacgacatggcttccggtgctgctgggatctcttggatgtaaaccactaaccatgtttcttataacagaaaataaaatctggggaagaaaaagttggcctctcaatgaaggaattatggctgttggaatagttagcatcctactaagttcacttctcaaaaatgatgtgccactagctggcccattaatagccggaggcatgctaatagcatgttatgtcatatccggaagctcggccgatttatcactggagaaagcggctgaggtctcctgggaagaagaagcagaacactctggcgcctcacacaacatactagtggaggtccaagatgatggaaccatgaagataaaagatgaagagagagatgacacaatcaccatcctcctcaaagcaactctgctagcaatctcaggggtgtatccaatgtcaataccggcgactctctttgtgtggtatttttggcagaaaaagaaacagagatcaggagtgctatgggacacacccagccctcctgaagtggaaagagcagtccttgatgatggcatttatagaattctccaaagagggttgttgggcaggtctcaagtaggagtaggagtttttcaagaaggcgtattccacacaatgtggcacgtcaccaggggagctgtcctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaacgtacagacagcgccgggtaccttcaagacctctgaaggcgaagttggagccatagctctagactttaaacctggcacatctggatctcctatcgtgaacagagagggaaaaatagtaggcctttatggaaatggagtggtgacaacaagtggaacctatgtcagtgccatagctcaagctaaagcatcacaagaagggcctctaccagagattgaggacgaggtgtttaggaaaagaaacctaacaataatggacctacatccaggatcgggaaaaacaagaagataccttccagccatagtccgtgaggccataaaaagaaagctgcgcacgctagtcttagctcctacaagagttgtcgcttctgaaatggcagaggcgctcaagggaatgccaataaggtatcagacaacagcagtgaagagtgaacacacgggaaaggaaatagttgaccttatgtgccacgccactttcactatgcgtctcctgtctcctgtgagagttcccaattataacatgattattatggatgaagcacatttcaccgatccagccagcatagcagccagagggtacatctcaacccgagtgggtatgggtgaagcagctgcgattttcatgacagccactccccccggatcggtggaggcctttccacagagtaatgcagttatccaagatgaggaaagagacattcctgaaagatcatggaactcaggctatgactggatcactgacttcccaggtaaaacagtctggtttgttccaagcatcaaatcaggaaatgacattgccaactgtttaagaaagaatgggaaacgggtgatccaattgagcagaaaaacctttgacactgagtaccagaaaacaaaaaataatgactgggactatgttgtcacaacagacatatccgaaatgggagcaaactttcgagccgacagggtaatagacccaaggcggtgcctgaaaccggtaatactaaaagatggtccagagcgtgtcattctagccggaccgatgccagtgactgtggctagtgccgcccaaaggagaggaagaattggaaggaaccaaaataaggaaggtgatcagtatatttacatgggacagcccctgaacaatgatgaggaccacgcccattggacagaagctaaaatgctccttgacaacataaacacaccagaagggattatcccagccctctttgagccggaaagagaaaagagtgcagcaatagacggggaatacagactacggggtgaagcgaggaaaacgttcgtggagctcatgagaagaggagatctacctgtctggctatcttacaaagttgcctcagaaggcttccaatactccgacagaagatggtgctttgatggggaaaggaacaaccaggtgttggaggagaacatggacgtggagatctggacaaaagaaggggaaagaaaaaaacttcgaccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaatgctttggacaatctggtcatgctgcacaactctgaacaaggaggaaaagcttatagacacgccatggaagaactaccagacaccatagagacgttaatgctcctagctttgatagctgcgctgactggtggagtgacgctgttcttcctatcaggaagaggcctaggaaaaacatccattggcctactctgcgtgatgtcctcaagtgcactgttatggatggccagtgtggagccccattggatagcggcctctatcatactggagttctttctgatggtgttgcttattccagagccagacagactgcgcactccacaagacaaccagctagcatatgtggcgataggtttgctattcataatattgacagtggcagccaatgagatgggattattggaaaccacaaagaaagacctggggattggccatgcagctgctgaaaaccaccaccacgctgcaatgctggacgtagacctacatccagcttcagcctggactctctatgcagtggccacaacgattatcactcccatgatgagacacacaattgaaaacacaacggcaaatatttccctgacagctattgcaaaccaggcagctatattgatgggacttgataagggatggccaatatcaaaaatggacataggagttccacttctcgccttggggtgctattctcaggtgaacccgctgacgctgacagcggcggtattgatgctagtagctcattatgccataattggacctggactgcaagcaaaagctactagagaagctcaaaaaaggacagcagccggaataatgaaaaacccaaccgtcgacgggatcgttgcaatagatttagaccccgtggtttatgatgcaaaatttgaaaaacagctaggccaaataatgttgttgatgctttgcacatctcagatcctcctgatgcggaccacatgggccttgtgtgaatccatcacactggccacaggacctctgaccacgctttgggagggatctccaggaaaattctggaacaccacgatagcggtgtccatggcaaacatttttaggggaagttatctagcaggagcgggtctggccttttcattaatgaaatctctaggaggaggtaggagaggcacaggagcccaaggggaaacactgggagaaaaatggaaaagacagctaaaccaattgagcaagtcagaatttaacacttacaagaggagtgggattatagaggtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccaatcccaatggcaacctatggatggaacctagtaaagctatactccgggaaggatgtattctttataccacctgagaaatgtgacacccttttgtgtgatattggtgagtcctctccgaacccgactatagaagaaggaagaacgttacgtgttctaaagatggtggaaccatggctcagaggaaaccaattttgcataaaaattctaaatccctacatgccgagtgtggtagaaactctggagcaaatgcaaagaaaacatggaggaatgctagtgcgaaatccactctcaagaaactccactcatgaaatgtactgggtttcatgtggaacaggaaacattgtgtcagcagtaaacatgacatctagaatgctgctaaatcgattcacaatggctcacaggaagccaacatatgaaagagatgtggacttaggcgctggaacaagacatgtggcagtagaaccagaggtggccaacctagatatcattggccagaggatagagaatataaaaaatgaacacaaatcaacatggcattatgatgaggacaatccgtacaaaacatgggcctatcatggatcatatgaggtcaagccatcaggatcagcctcatccatggtcaatggtgtggtgagactgttaaccaaaccatgggatgtcattcccatggtcacacaaatagccatgactgacaccacaccctttggacaacagagggtgtttaaagagaaagttgacacgcgtacaccaaaagcgaaacgaggcacagcacaaattatggaggtgacagccaggtggttatggggtttcctctctagaaacaaaaaacccagaatctgcacaagagaggaattcacaagaaaagtcaggtcaaatgcagctattggagcggtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggaaggagaaggactccacaaacttggatacatactcagagacatatcaaagattccaggaggaaatatgtatgcagatgacacagccggatgggacacaagaataacagaggatgatcttcagaatgaggccaaaattactgacatcatggaacctgaacatgccctactggccacgtcaatcttcaagctaacctaccaaaacaaagttgtaagggtgcagagaccagcaaaaaatggaaccgtgatggatgttatatccaggcgtgaccagagaggaagtggacaggttggaacctatggcctaaacaccttcaccaacatggaggcccaactaataagacaaatggagtctgagggaatcttttcacccagcgaattggaaaccccaaatctagctggaagagtcctcgactggttggaaaaacatggcatcgagaggttgaaaagaatggcaatcagtggagatgactgtgtggtgaaaccaattgatgacagatttgcaacagccttaacagccttgaatgacatgggaaaggtaagaaaagacataccgcaatgggaaccttcaaagggatggaatgattggcaacaagtgcctttctgttcacaccatttccaccagctgattatgaaggatgggagggagatagtggtgccatgccgcaaccaagatgaacttgtaggtagggccagagtatcgcaaggcgccggatggagcttgagagaaactgcatgtctaggcaagtcatatgcacaaatgtggcagctgatgtacttccacaggagagacttgagactagcggctaatgctatctgttcagccgttccagttgattgggttccaaccagccgcaccacctggtcgatccatgcccaccatcaatggatgacaacagaagacatgttgtcagtgtggaatagggtttggatagaggaaaacccatggatggaggataaaactcatgtgtccagttgggaagacgttccatacctagggaaaagggaagatcaatggtgtggatccctaataggcttaacagcacgagccacctgggccactaacatacaagtggccataaaccaagtgagaaggctcatcgggaatgagaattatctagactacatgacatcaatgaagagattcaaaaacgagagtgatcccgaaggggcactctggtaa

SEQ ID NO: 25 - DNA, 10179 bp, Dengue virus
atgaacgaccaacggaaaaagacgggtcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagaatggagcgattaaagtgctacggggttttaagaaagaaatctcaaacatgttaaacataatgaatagaagaaaaagatccgtgaccatgctccttatgctgctgcccacagccctggcgttccatctgaccacacgagggggagagccgcacatgatggttagcaagcaggaaagaggaaagtcacttttgtttaagacctctgcaggtgtcaacatgtgcacccttattgcgatggatttgggagagttatgtgaggacacaatgacctacaaatgcccccggatcactgaggcggaaccagatgacgttgattgttggtgcaatgccacggacacatgggtgacctatggaacgtgttctcaaactggcgaacaccgacgaggcaaacgttccgtcgcactggccccacacgttgggcttggtctagaaacaagagccgaaacgtggatgtcctctgaaggcgcttggaaacaaatacaaaaagtggagacttgggctctgagacacccaggattcacagtgatagccctttttctagcacatgccataggaacatccatcacccagaaagggattattttcattttgttgatgctggtaacaccatccatggccatgcgatgcgtgggaataggcaacagagacttcgtggaaggactgtcaggagcaacgtgggtggatgtggtactggagcatggaagttgcgtcaccaccatggcaaaaggtaaaccaacattggacattgaactcttgaagacggaggtcacaaaccctgccgtcctgcgtgaactgtgcattgaagctaaaatatcaaacaccatcaccgattcaagatgtccaacacaaggagaagccacactggtggaagaacaagacgcgaacttcgtgtgtcgacgaacgtttgtggacagaggctggggcaatggctgtgggcttttcggaaaaggtagcctaataacgtgtactaagttcaagtgtgtgacaaaactggaagggaagatagttcaatatgagaacttgaaatattcagtgatagtcaccgtccacactggagaccagtaccaggtgggaaatgagactacagaacatggaacaattgcaaccataacacctcaagctcctacgtcggaaatacagctgaccgactacggagctcttacattggattgctcacctagaacagggctagactttaatgagatggtgttgttgacaatgaaagaaaaatcatggcttgtccacaaacaatggtttctagacttaccactgccttggacctcgggagcttcaacacccaaagagacttggaacagacaagatttgctggttacatttaagacagctcatgcaaagaagcaggaagtagccgtactaggatcacaagaaggagcaatgcacactgcgctgaccggagcgacagaaatccaaacgtctggaacgacaaaaatttttgcaggacacttgaaatgtagactaaaaatggataaactgactttaaaagggatgtcatatgtgatgtgcacaggctcattcaagttaaagaaagaagtggctgagacccagcatggaactgttctagtgcaggttaaatacgaaggaacagatgcaccatgcaagatccccttttcgacccaagatgagaaaggagtaatccagaatgggagattgataacagctaaccccatagtcactgacaaagaaaaaccagtcaacattgaggcagaaccaccttttggtgagagttacatcgtggtaggagcaggtgaaaaagctttgaaactaagctggttcaagaaaggaagcagcatagggaaaatgtttgaagcaactgcccgaggagcacgaaggatggccatcctgggagacatcgcatgggactttggctctataggaggagtgttcacgtctgtgggaaaactggtacaccagatttttggaactgcatatggaattttgttcagcggtgtttcctggactatgaaaataggaatagggattctgctgacatggctaggattaaattcaaggagtacgtccctttcgatgacatgcattgcagttggcatggttacactgtacctaggagtcacggttcaggcggactcgggatgtgtagttaactggaaaggcagagagctcaaatgtggaagtggcatttttgtcaccaatgaagttcacacttggacagagcaatacaaattccaggccgactccccaaagagactatcagcagccattgggaaggcatgggaggagggtgtgtgtggaattcgatcagccactcgtctcgagaacatcatgtggaagcaaatatcaaatgaactaaaccacattttacttgaaaatgacatgaaactcacagtggtcgtaggagatgttagtgggatcttggcccaagggaaaaaaatgattgggccacaacccatggaacacaaatactcgtggaaaagctggggaaaagctaaaatcataggagcagatgtacagaacaccaccttcatcatcgacggcccaaacaccccagaatgccctgacgaccaaagagcatggaacatttgggaagttgaggactatggatttggaattttcacgacaaacatatggttgaaattgcgtgactcctacactcaagtgtgtgaccaccggctaatgtcagctgccatcaaggacagcagggcagttcatgctgacatggggtactggatagaaagtgaaaagaacgagacctggaagctggcgagagcctccttcatagaagttaagacatgcgtctggccaaaatcccacactctatggagcaatggagttctggaaagtgaaatgataatcccaaagatatatggaggaccaatatctcagcacaactacagaccaggatattccacacaaacagcagggccgtggcacctaggcaagttggaactagattttgatttgtgtgagggtaccacagttgttgtggatgaacattgtggaaatcgaggaccatctcttagaaccacaacagtcacaggaaaggtaatccatgaatggtgctgtagatcctgcacgctaccccccttacgtttcaaaggagaagacgggtgttggtacggcatggaaatcagaccagtcaaggacaaggaagagaacctagttaagtcaatggtctctgcagggtcaggagaagtggatagcttttcactaggactgctatgcatatcaataatgatcgaagaggtgatgagatctagatggagtagaaaaatgctgatgactggaacactggctgtgttcctccttctcataatgggacaattgacatggaatgatctgatcaggttatgcatcatggttggagccaatgcttcagacaggatggggatgggaacaacgtacctagctctgatggccacttttaaaatgagaccaatgttcgctgtcgggctattatttcgtagactaacatctagagaagttcttcttcttacgattggattaagtctggtggcatgcgtggagctaccaaattccttggaggagctgggggatggacttgcaatgggcatcatgattttaaaattactgactgactttcagtcacatcagctgtgggctgccctgctgtccttgacatttatcaaaacaactttctcattgcactatgcatggaagacaatggctatggtactgtcaattgtatctctcttccctttatgcctgtccacgacctctcaaaaaacaacatggcttccggtgctgttgggatctcttggatgcaaaccactaaccatgtttcttatagcagaaaacaaaatctggggaaggaaaagttggcccctcaatgaaggaatcatggctgttggaatagttagcatcctactaagttcactcctcaaaaatgatgtgccgctagccggcccactaatagctggaggcatgctgatagcatgttatgttatatccggaagctcggccgatttatcactggagaaagcggccgaggtctcctgggaagaagaagcagaacactctggcacctcacataacatactagtggaagtccaagatgatggaaccatgaagataaaagatgaagagagagatgacacactcaccattctcctcaaagcaactctgctggcagtctcaggggtgtacccaatatcaataccagcgaccctttttgtgtggtatttttggcagaaaaagaaacagagatcaggagtgctatgggacacacctagccctccagaagtggaaagagcagttcttgatgatggtatctatagaattttgcaaagaggactgttgggcaggtcccaagtaggagtaggagttttccaagaaggcgtgttccacacaatgtggcatgtcaccaggggagctgtcctcatgtatcaagggaagagactggaaccgagttgggccagtgtcaaaaaagacttgatctcatatggaggaggttggaggtttcaaggatcctggaacataggagaagaagtgcaggtgattgctgttgaaccggggaaaaaccccaagaacgtacagacagcgccgggcacctttaagacccctgagggcgaagttggagccatagccctagatttcaaacccggcacatctggatctcccatcgtgaacagagagggaaagatagtaggtctttatggaaatggagtggtgacaacaagtggaacctacgtcagtgccatagctcaagctaaagcatcacaagaagggcctctaccagagattgaggacgaggtgtttaggaaaagaaacctaacaataatggacttacatccaggatcggggaaaacaagaagatatcttccagccatagtccgtgaggctataaaaaggaagctgcgtacgctaatcttggctcccacaagagttgtcgctgctgaaatggcagaggcgctcaagggaatgccaataaggtatcagacaacagcagtgaagagtgaacacacaggaaaggagatagttgaccttatgtgccacgctactttcaccatgcgtctcctgtctcccgtgagagttcccaattacaacatgattatcatggatgaagcacatttcaccgatccagccagcatagcggccagagggtacatctcaacccgagtgggcatgggtgaagcagctgcgatctttatgacagccactcccccaggatcggtggaggcctttccacagagcaatgcagttattcaagatgaggaaagagacattcctgagagatcatggaactcaggctatgactggatcactgatttcccaggtaaaacagtctggtttgttccaagcattaaatcaggaaatgacattgccaactgtttaagaaagaatgggaaacgggtgatccaattgagcagaaaaacctttgatactgagtaccagaaaacaaaaaataacgactgggactatgtcgtcacaacagacatttccgaaatgggagcaaacttccgagccgacagggtaatagacccaagacggtgtctgaaaccggtaatactaaaagatggtccagagcgtgtcattctagccggaccgatgccagtgactgtggccagtgctgcccagaggagaggaagaattggaaggaaccaaaataaggaaggtgatcagtatatttacatgggacagccttcaaacaacgatgaggatcacgctcattggacagaagcaaaaatgctccttgacaatataaacacaccggaagggattatcccagccctctttgagccggagagagaaaagagtgcagcaatagacggggaatacagactgcggggtgaagcaaggaaaacgttcgtggagctcatgagaagaggagacctacctgtctggctatcctacaaagttgcctcagaaggcttccagtactctgacagaaggtggtgctttgatggggaaaggaataaccaggtgttggaggagaacatggacgtggagatctggacaaaagaaggagaaagaaagaaactacgaccccgctggctggatgccagaacatactctgacccactggctctgcgcgagtttaaagagtttgcagcaggaagaagaagcgtcgcaggtgacctaatattagaaatagggaaacttccacaacatttgacgcaaagggcccagaatgctttggacaacctggtcatgttgcacaactccgaacaaggaggaaaagcctatagacatgctatggaagaactaccagacaccatagaaacgttgatgctcctagctttgatagctgtgttaactggtggagtgacgctgttcttcctatcaggaagaggcctagggaaaacatctatcggcctactctgcgtgatggcttcaagcgtactgttatggatgtccagtgtggagccccattggatagcggcttccattatactggagttctttctgatggtgctgcttattccagagccagacagacaacgcactccacaggacaaccagctggcatatgtggtgataggtttgttattcatgatattgacagtagcagccaatgagatgggattattggaaaccacaaagaaagacctagggattggccatgtggctgttgaaaaccaccaccatgccacaatgctggacgtagacttacatccagcttcagcctggactctttatgcagtggccacaacaattatcactcccatgatgagacatacaattgaaaacacaacggcaaatatttccctgacagctattgcaaaccaggcagctatattgatgggacttgacaagggatggccaatatcgaagatggacataggagttccacttctcgccttggggtgctattcccaggtgaacccgctgacgctgacagcggcggtaatgatgctagtggctcattacgccataattggacctggactgcaagcaaaagctactagagaagctcaaaaaaggacagcggccggagtaatgaaaaacccaactgtcgacggaattgatgcaatagacttggaccctgtggtttatgatgcaaaatttgaaaaacagctaggccaaataatgttgttgatgctttgcacatcacagatcctcctgatgcggaccacatgggccttgtgtgaatccatcacactggctactggacctctgaccacgctttgggagggatctccaggaaaattctggaacaccacgatagcggtgtccatggcaaacattttcaggggaagttatctagcaggagcaggcctggccttctcattaatgaaatctctaggaggaggtaggagaggtacgggagcccaaggggaaacactgggagaaaaatggaaaagacagctaaaccaactgagcaagtcagaattcaacacttacaaaaggagtgggattatggaggtggatagatccgaagccaaagagggactgaaaagaggagaaacaaccaaacatgcagtgtcgagaggaacagccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccaatcccaatggcgacctatggatggaacctagtaaagctacactccgggaaagatgtattcttcacaccacctgagaaatgtgacacccttttgtgtgatattggtgagtcctctccgaacccaactatagaagaagggagaacgttacgtgttctaaagatggtggaaccatggctcagaggaaaccaattttgcataaaaattctaaatccctatatgccgagtgtggtggaaactctggagcaaatgcaaagaaaacatggaggaatgctggtgcgaaatccactctcaagaaattccacccatgaaatgtactgggtttcatgtggaacaggaaacattgtgtcagcagtaaacatgacatctagaatgttgctaaatcgattcacaatggcccataggaagccaacatatgaaagagacgtggacttaggtgctgggacaagacatgtggcagtggaaccagaggtagccaacctagacatcattggccagaggatagagaatataaaaaatgagcataagtcaacatggcattatgatgaggacaatccatacaaaacatgggcctatcatggatcatatgaggttaagccatcaggatcagcctcatccatggtcaatggcgtggtgagattgctcaccaaaccatgggacgttatccccatggtcacacaaatagccatgactgacactacaccctttggacaacagagggtgtttaaagagaaagttgacacgcgtacaccaaaagcaaaacgaggcacagcacaaatcatggaggtgacagccaggtggttatggggttttctttctagaaacaaaaaaccaagaatttgcacaagagaggagttcacaagaaaagttaggtcaaacgcagctattggagcagtgttcgttgatgaaaaccaatggaactcagcgaaagaagcagtggcagatgaacggttctgggaccttgtgcacaaagagagggagcttcataaacagggaaaatgtgccacgtgtgtttacaatatgatggggaagagagagaaaaaattaggagagttcggaaaggctaaaggaagtcgtgcaatatggtacatgtggttgggagcacgctttctagagttcgaagcccttggtttcatgaatgaagatcactggttcagtagagagaattcactcagcggagtggaaggagaaggacttcacaaacttggatatatactcagagacatatcaaagattccagggggaaatatgtatgcagatgacacagccggatgggacacaagaataacagaggatgatcttcagaatgaggccaaaatcactgacattatggagcccgaacatgccctattggctacgtcaatctttaagctgacctaccaaaacaaggtggtaagggtgcagagaccagcaaaaaatggaaccgtgatggatgtcatatccagacgtgaccagagaggaagtggacaggtcggaacttatggcttaaacactttcaccaacatggaggcccaactaataagacaaatggagtctgagggaatcttttcacccagcgaattggagaccccaaatttagccgaaagagttctcgactggttggaaaaacatggcgtcgaaaggctgaaaagaatggcaatcagcggagatgactgtgtggtgaaaccaattgatgacaggttcgcaacagccttaacagctttgaatgacatgggaaaagtaagaaaagacataccgcaatgggaaccttcaaaaggatggaatgattggcaacaagtgcctttttgttcacaccatttccaccagctgattatgaaggatgggagggagatagtggtgccatgccgcaaccaagatgaacttgtgggtagggctagagtatcacaaggcgccggatggagcctgagagaaactgcatgcctaggcaagtcatatgcacaaatgtggcagctgatgtacttccacaggagagacctgagactagcggccaatgccatctgttcagccgttccagttgattgggtcccaaccagccgcaccacctggtcgatccatgcccatcatcaatggatgacaacagaagacatgttgtcagtgtggaatagggtttggatagaggaaaacccatggatggaggacaaaacccatgtatccagttgggaagatgttccatatttagggaaaagggaagatcagtggtgtggatccctgataggcttaacagcgagggccacctgggccactaatatacaagtggccataaaccaagtgagaaggcttattgggaatgagaattatctagattacatgacatcaatgaagagattcaagaatgagagtgatcccgaaggggcactctggtaa

SEQ ID NO: 26 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggtcaaggacccatgaaactggtgatggcttttatagcattcctaagatttctagccatacctccaacagcaggaattttggctagatggggctcattcaagaagaatggagcgattaaagtgttacggggtttcaaaaaagaaatctcaaacatgttgaacataatgaacaggaggaaaagatctgtgaccatgctcctcatgctgctgcccacagtcctgacgttccatttgaccacccgagggggagagcctcacatgatagttagcaaacaggaaagaggaaagtcacttttgtttaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggattcacggtgatagccctttttctagcacatgccataggaacatccatcacccagaaagggattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgcatagaagctaaaatatcaaataccaccactgactcgagatgtccgacacaaggagaagccacgctggtggaagaacaagacgcgaactttgtgtgtcgacgaacattcgtggacagaggctggggcaatggttgtggactattcggaaaaggtagcttaataacgtgtgctaagtttaagtgtgtgacaaaattggaaggaaagatagtccaatatgaaaacttaaaatattctgtgatcgttaccgtccacactggagaccagcaccaagttggaaatgagaccacagaacatggaacaattgcaaccataacacctcaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggacctcaggggcctcaacgtcccaagagacttggaatagacaagacttgctggtcacatttaagacagctcatgcaaagaagcaggaagcagtcgtactaggatcacaagaaggagcaatgcacactgcgttgactggagcgacagaaatccaaacgtctggaacgacaacaatttttgcaggccacctgaaatgcagactaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagctggttcaagaagggaagcagtatagggaaaatgtttgaagcaactgcccgtggagcacgaaggatggccatcctgggagacaccgcatgggacttcggttctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtcactaatgaagttcacacctggacagagcaatacaaattccaggctgactccccaaagagactatcagcagccattgggaaggcatgggaggagggggtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcatggaacatctgggaagttgaagactatggatttggaattttcacgacaaatatatggttgaaattgcgtgattcctacacccaagtgtgtgaccatcgactaatgtcggctgccatcaaggatagcaaagcagtccatgctgacatggggtactggatagaaagtgaaaagaacgagacttggaagttggcaagagcctccttcatagaagtcaagacatgcgtctggccaaaatcccacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagttgttgtggatgaacattgtggaaatcgcggaccatctcttagaaccacaacagtcacaggaaagataatccatgaatggtgctgcagatcttgcacgttaccccctctacgtttcaaaggggaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtagggctattatttcgcagattaacatctagagaagttcttcttctcacggttggattgagtctggtggcatctgtagaactaccaaattccttagaggagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccggtgcttctgggatctcttggatgcaaaccactaaccatgtttctcataacagaaaacaaaatctggggaaggaaaagttggcctctcaacgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggtatttttggcagaaaaagaaacagagatcaggagtgttatgggacacacccagccctccagaagtggaaaaagcagtccttgatgatggcatttacagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatttcatatggaggaggttggaggtttcaaggatcctggaacacgggagaagaagtgcaggtgattgctgttgaaccggggaagaacccaaaaaatgtacagacagcgccaggtaccttcaagacctctgaaggcgaagttggagccatagctctagactttaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttttagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcctttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattgagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggtaatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggagagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaaggtggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaatgctttggataatctggttatgctgcacaactctgaacaaggaggaaaagcttatagacacgccatggaagaattgccagacaccatagagacaataatgctcctagctttgatagctgtgctgactggtggagtgacgctgttcttcctatcaggaagaggcttagggaaaacatccataggcctactctgcgtgatgtcctcaagtgcactgttatggatggccagtgtggagccccattggatagcggcctctattatactagagttctttctgatggtgttgcttattccagagccagatagacagcgcactccacaagacaaccagttagcatatgtggtgataggtttgctattcatgatattgacagtggcagccaatgagatgggattattggaaaccacaaagaaagacctggggattggtcatgcagctgctgaaaaccaccaccacgccgcaatgctggacgtagacctacatccagcttcagcctggaccctctacgcagtggccacaacgattatcactcccatgatgagacacacaattgaaaacacaacggcaaatatttccctgacagctattgcaaaccaggcagctatattgatgggacttgataagggatggccaatatcaaagatggacataggagttccacttctcgccttggggtgctattctcaggtgaacccgctgacgctgacagcggcggtactgatgctagtagcccattatgccataattggaccaggactgcaagcaaaagccactagagaagctcaaaaaaggacggcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttagggggagttatctagcaggagcgggtctggccttttcattaatgaaatctctgggaggaggtaggagagggacgggagcccaaggggaaacactgggagaaaagtggaaaagacagctgaaccaattgagcaagtcagaatttaacacttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaacctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaatcaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaatcgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgtacaccaaaagcgaaacgaggcacagcacaaatcatggaggtgacagccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgccacatgcgtctacaacatgatgggaaagagagagaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgagggaatcttttcacccagcgaattggaaaccccaaatttagccggaagagtccttgactggttggaaaaacatggcaccgagaggctgagaagaatggcaatcagtggagatgactgtgtggtgaaaccaattgatgacagatttgcaacagccttaacagccttgaatgacatgggaaagataagaaaagacataccgcaatgggaaccttcaaaaggatggaatgattggcaacaagtgcccttctgctcacaccacttccaccagctgattatgaaggatgggagggagatagtggtgccatgccgcaaccaagatgaactggtaggtagggccagagtgtcacaaggcgccggatggagcttgagagaaactgcatgtctaggcaagtcgtatgcacaaatgtggcagctgatgtacttccacaggagagacttgagactagcggctaatgccatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattatctagactacatgacatcaatgaagagattcaaaaacgagagtgatcccgaaggggcactctggtaa

SEQ ID NO: 27 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgactaaagtgttacggggtttcaagaaagaaatctcaaacatgttgaacataatgaatagaaggaagagatccgtgaccatgctccttatgctgctgcccacagtcttggcgtttcatctgaccacacgagggggagagccgcatatgatagttaccaagcaggaaagaggaaagtcacttttgtttaagacctcagctggtgtcaacatgtgcacccttattgcgatggatttgggagaactatgtgaggacacaatgacttacaaatgtcctcgaatcactgaggcggaaccagatgacgttgattgttggtgcaatgccacagacacatgggtgacctatggaacgtgttctcaaactggcgagcaccgacgagacaaacgttccgtcgcactggctccacacgtgggacttggtctagaaacaagaaccgaaacgtggatgtcctctgaaggcgcttggaaacaaatacaaagagtggagacttgggccctgagacacccaggattcacagtgatagccctttttctagcacatgccataggaacatccatcacccagaaagggattattttcattttgttgatgctggtaacaccatccatggccatgcgatgtgtgggaataggcaacagggactttgtggaaggactgtcgggagcaacgtgggtagatgtggtactggaacatggaagctgtgtcaccaccatggcaaaagacaaaccaacattggacattgaactcttgaagacggaagtcacaaaccctgccgtcctgcgcaaactgtgcattgaagctaaaatatcaaacacaaccaccgattcaagatgtccaacacaaggagaagccacactggtggaagaacaagacgcgaattttgtgtgtcgacgaacgtttgtggacagaggctggggcaatggctgtgggcttttcgggaaaggtagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaacagcaactataacacctcaagctcctacgtcggaaatacagctgaccgactacggagctcttacattggattgctcacctagaacaggactagacttcaatgaaatggtgttgttgacaatgaaagaaaaatcatggctagtccacaaacaatggtttctagacctaccactgccttggacctcgggagctacaacgtcacaagagacttggaacagacaagatttgctggtaacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaaaatggataaactgactctaaaagggatgtcatatgtgatgtgcacaggctcattcaagctagagaaagaggtggctgagacccagcatggaaccgttctactgcaggttaaatacgaaggaacagatgcaccatgcaagatccctttttcgacccaagatgaaaaaggagtaactcagaatgggagagtgataacagccaaccctatagtcactgataaggaaaaaccagtcaacattgaggcagaaccaccttttggtgagagttacatcgtggtaggagcaggtgaaaaagctttgaaactaagctggttcaagaaaggaagcaccatagggaaaatgtttgaggcaactgcccgaggagcacgaaggatggccatactgggagacaccgcatgggactttggttccataggaggagtgttcacatctgtcggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctggtaacactgtacctaggagtcatggttcaggcggattcgggatgtgtgattaattggaaaggcagagaactcaaatgtggaagtggcatttttgtcaccaatgaagttcacacttggacagagcaatacaaatttcaggctgactccccaaaaagactatcagcagccatcgggaaggcatgggaggagggtgtgtgtggaattcgatcagccactcgtctcgagaacatcatgtggaagcaaatatcaaatgaactgaaccacatcttacttgaaaatgacatgaaattcacagtggtcgtaggagatgttagtgggatcttggcccaggggaaaaaaatgattaggccacaacccatggaacacaaatactcgtggaaaagctggggaaaagctaaaatcataggggcagatgtacagaactccaccttcatcattgacggcccaaacaccccagaatgccccgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcatgctgacatggggtactggatagaaagtgaaaagaacgagacttggaagctggcaagagcctccttcatagaagttaaaacatgcgtttggccaaaatcccacactctatggagcaatggagttctggaaagtgaaatgataattccaaagatatatggaggaccaatatctcagcacaactacagaccaggatatttcacacaaacagcagggccgtggcacttaggcaagttggaactagattttgatttgtgtgagggtaccacagttgttgtggatgaacattgtggaaatcgaggaccatctcttagaaccacaacagtcacaggaaaaataatccatgaatggtgctgcagatcctgtacgctaccacccttacgtttcaaaggagaagatgggtgttggtatggtatggaaattagaccagtcaaggaaaaggaagagaatctagttaaatcaatggtctctgcagggttaggagaagtggacagcttttcactaggactgctatgcatatcaataatgattgaggaggtgatgagatctagatggagtagaaaaatgctgatgactggaacactggctgtgttcctccttctcatactgggacaattgacatggaatgatctgatcaggttatgcatcatggttggagccaatgcttcagacaggatggggatgggaacaacgtacctagctctgatggccacttttaaaatgaggccaatgtttgctgtcgggctattattccgcagactaacatctagagaagttcttcttctcacaattggattgagtctagtggcatccgtggagctaccaaattccttggaggagctgggggatggacttgcaatgggcattatgatcttaaaattactgactgactttcagtcacatcagctgtgggctgccttgctgtccctgacatttatcaaaacaactttttctctgcactatgcatggaagacaatggctatggtactgtcaattgtgtctctcttccccttatgcatgtccacgacctctcaaaaaacaacatggcttccggtgctattgggatctcttggatgcaaaccactaaccatgtttcttatagcagaaaacaaaatctggggaaggaaaagttggcctctcaatgaaggaatcatggctgttggaatagtcagcatcttactaagttcactcctcaagaatgatgtgccgctagctgggccactaatagctggaggcatgctaatagcatgttatgttatatctggaagctcagctgatttatcactagagaaagcggctgaggtctcctgggaagaagaagcagaacactctggcgcatcacacaatatattagtggaggtccaagatgatggaaccatgaagataaaagatgaagagagagatgacacactaaccattctccttaaagcgactctgctggcagtttcaggggtgtacccattatcaataccagcgaccctttttgtgtggtatttttggcagaaaaagaaacagagatcaggagtgttatgggatacacctagccctccagaagtggaaagagcagttcttgatgatggtatctatagaattatgcagagaggactgttgggcagatcccaagtaggggtaggagttttccaagaaaacgtgttccacacaatgtggcatgtcaccaggggagctgtactcatgtatcaagggaagagactggaaccgagttgggctagtgtcaaaaaagacctgatctcatatggaggaggttggaggcttcaaggatcctggaacacgggagaagaagtgcaggtgattgctgttgaaccagggaaaaaccccaaaaatgtacagacagcgccgggcaccttcaagacccctgaaggtgaagttggagccatagccctagattttaaacccggcacatctggatcccccatcgtgaacagagaggggaaaatagtaggtctttatggaaatggagtagtgacaacaagtggaacctacgtcagtgccatagctcaagctaaagcatcacaagaagggcccctaccagagattgaggacgaggtgtttaggaaaagaaacttaacaataatggacctacatccaggatcaggaaaaacaagaagatatcttccagccatagtccgtgaggccataaaaaggaagctgcgcacactaattttggctcccacaagagttgtcgcttcagaaatggcagaggcgctcaagggaatgccgataaggtatcagacaacagcagtgaagagtgaacacacaggaaaggagatagttgacctcatgtgccacgccactttcactatgcgtcttctgtctcccgtgagagttcccaattacaacatgattatcatggatgaagcacacttcaccgatccatccagcatagcggccagagggtacatctcaacccgagtgggtatgggtgaagcagctgcgatctttatgacagccactcccccaggatcagtggaggcctttccacagagcaatgcaattatccaagatgaggaaagagacattcctgagagatcatggaactcaggctatgactggatcactgacttcccaggtaaaacagtctggtttgttccaagcatcaaatcaggaaatgacattgccaactgtttaagaaagaatgggaaacgggtgattcaattgagcaggaaaacctttgacacagagtaccaaaagacaaaaaacaacgactgggactatgtcgtcacaacagacatctccgaaatgggagctaacttccgagccgacagggtaatagacccaagacggtgtttgaaaccggtaatactaaaagatggtccagagcgtgtcattctagcaggaccaatgccagtgactgtggccagtgctgcccagaggagaggaagaatcggaaggaaccaaaataaggaaggtgatcagtacatctacatgggacagcctttaaacaacgatgaagaccacgctcattggacagaagcaaaaatgctccttgataacataaacacaccagaagggatcatcccagccctctttgaaccggagagagaaaagagtgcggcaatagacggggaatatagactgcggggtgaagcaaggaaaacgtttgtggagctcatgagaagaggggatctacctgtctggctatcctacaaagttgcctcagaaggcttccagtactctgacagaagatggtgctttgatggggaaaggaacaatcaggtgttggaggagaacatggacgtggagatttggacaaaagaaggagaaagaaagaaactacgaccccgctggcttgatgccagaacatactcagacccattggccctgcgcgagtttaaagagtttgcagcaggaagaagaagcgtctcaggtgatctaatattagaaatagggaaacttccacagcacttgacgcaaagggcccagaatgccttggacaacctggtcatgttgcacaactccgaacaaggaggaagagcctacagacatgcaatggaagaactcccagacaccatagaaacgttgatgctcctagctttgatagctgtgttaactggtggagtgacgctgttcttcctatcaggaaggggcttagggaaaacatctatcggcctactttgcgtgatggcttcaagcgtgctgttatggatggccagtgtggagccccattggatagcggcctccatcatactggagttcttcctgatggtgctgcttattccagagccagacagacaacgcactccacaggacaaccagttggcatatgtagtgataggtttgttattcatgatactgacagtagcagccaatgagatgggattactggaaaccacaaagaaagacttggggattggccatgtggctgttgaaaatcaccaccatgccacaatgctggacgtagacttacatccagcttcagcctggaccctctatgcagtggccacaacaattatcacccccatgatgaggcacacaatcgaaaacacaacggcaaatatttccctgacagctattgcaaaccaggcagccatattgatgggactcgacaaaggatggccaatatcgaagatggacataggagttccacttctcgccttggggtgctattcccaggtgaatccactgacgctgacagcggcagtattgatgctagtggctcattacgccataattggacctggactgcaagcaaaagccactagagaagcccaaaaaaggacagcggccggaataatgaagaatccaactgtcgatggaatagttgcaatagatttggaccctgtggtctatgatgcaaaatttgagaaacaactaggccaaataatgttgttgatactatgcacatcacagatcctcttgatgcggactacatgggccttgtgtgaatccatcacactggctactggacctctgaccacgctttgggagggatctccaggaaaattttggaacaccacgatagccgtgtccatggcaaacatattcaggggaagttatctagcaggagcaggcctggccttctcactaatgaaatctctaggaggaggtaggagaggtacgggagcccaaggggaaacactgggagaaaaatggaaaagacagctaaaccaactgagcaagtcagaattcaacacttacaaaaggagtgggattatagaagtggatagatccgaagccaaagagggactgaaaagaggagaaacaaccaaacatgcagtatcgagaggaaccgctaaactgaggtggtttgtggagaggaaccttgtgaaaccagaagggaaagttatagacctcggatgtggaagaggtggctggtcatattattgcgccgggctgaagaaagtcacagaagtgaagggatacacaaaaggaggagctggacatgaggaaccaatcccaatggcgacctatggatggaacctagtaaaactatactccgggaaagacgtattctttacaccacctgaaaaatgtgacacccttttgtgtgacattggtgagtcctctccgaacccaaccatagaagaaggaagaacgttacgtgtcttaaagatggtggaaccatggctccgaggaaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacttaggcgctggaacaagacatgtggcagtggaaccagaggtagccaacctagatatcattggccagaggatagagaacataaaacatgaacataagtcaacatggcattatgatgaggacaatccatacaagacatgggcctatcatggatcatatgaggttaagccatcaggatcagcctcatccatggtcaatggcgtggtgagactgctcaccaaaccatgggatgtcattcccatggtcacacaaatagccatgactgacaccacaccctttggacaacagagggtgtttaaagagaaagttgacacgcgcacaccaagagcgaaacaaggcacagcacaagtcatggaggtgacagctaggtggttatggggttttctttctagaaacaaaaaaccaagaatctgcacaagagaggagttcacaagaaaagttaggtcaaacgcagccattggagcagtgttcgttgatgaaaatcaatggaactctgcaaaagaagcagtggaagatgagcggttttgggaccttgtgcacagagagagggagcttcacaaacagggaaaatgtgccacatgtgtttacaatatgatgggaaaaagagagaaaaaactaggagagtttggaaaggcaaaaggaagtcgtgcaatatggtacatgtggttgggagcacgctttctagagtttgaagcccttggtttcatgaacgaagatcactggttcagtagagagaattcactcagcggagtggaaggagaaggactccacagactcggatatatactcagagacatatcaaagattccagggggaaacatgtatgcagatgacacagccggatgggatacaaggataacagaggatgatcttcagaatgaggcaaaaatcactgacatcatggagcccgaacatgccctactggctacgtcaatctttaagctgacctaccaaaataaggtggtgagggtgcagagaccagcaaaaaatggaaccgtgatggatgttatatccagacgtgaccagagaggaagtggccaggtcggaacttatggcttaaacactttcaccaacatggaggcccagctaataagacaaatggagtctgagggaatcttttcacccagcgaattagagaccccaaatttggccgagagagttctcgactggttggaaaaatatggcgtcgaaaggctgaaaagaatggcaatcagcggagatgactgcgtggtgaaaccaattgatgataggttcgcaacagccctaacagctctgaacgatatgggaaaagtaagaaaagacataccacaatgggaaccttcaaaaggatggaatgactggcaacaagtgcctttttgttcacaccatttccaccagctgattatgaaggatgggagggaaatagtggtgccatgccgcaaccaagatgaactcgtgggtagggctagagtgtcacaaggtgccggatggagcctgagagaaactgcatgcctgggcaagtcatatgcacaaatgtggcagctgatgtacttccacaggagagacctgagactagctgctaatgccatctggtcagccgttccagttgatggggtcccaaccagccgcaccatttggtcgatccacgcccatcatcaatggatgacaacagaaaacatgttgtcagtgtggaatagggtttggatagaggaaaacccatggatggaggacaaaacccatgtgtccagttgggaagatgttccatatttagggaaaagggaagatcagtggtgtggttccctgataggcttaacagcaagggccacctgggccactaacatacaagtagccataaaccaagtgagaaggctaattgggaatgagaattatctagattacatgacatcaatgaagagattcaagaacgatagcgatcctgaaggggtactctggtga

SEQ ID NO: 28 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgattaaagtgttacgaggtttcaagaaagaaatctcaaacatgttgaatgtaatgaatagaaggaagagatccgtgaccatgcttcttatgctgctgcccacagtcttggcgtttcatctgaccacacgagggggagagccgcatatgatagttaccaagcaggaaagaggaaagtcacttttgtttaagacctcagctggtgtcaacatgtgcacccttattgcgatggatttgggagagttatgtgaggacacaatgacttacaaatgtcctcgaatcactgaggcggaaccagatgacgttgattgttggtgcaatgccacagacacatgggtgacctatggaacgtgttctcaaactggcgagcaccgacgagacaaacgttccgtcgcactggctccacacgtgggacttggtctagaaacaagaaccgaaacgtggatgtcctctgaaggcgcttggaaacaaatacaaagagtggagacttgggccctgagacacccaggattcacagtgatagcccttttcctagcacatgccataggaacatccatcacccagaaagggattattttcattttgctgatgctggtaacaccatccatggccatgcgatgtgtgggaataggcaacagggactttgtggaaggactgtcgggagcaacgtgggtagatgtggtactggaacatggaagctgtgtcaccaccatggcaaaagataaaccaacattggacattgaactcctgaagacggaagtcacaaaccctgccgtcctgcgcaaactgtgcattgaagctaaaatatcaaacaccaccaccgattcaagatgtccaacacaaggagaagccacactggtggaagaacaagacgcgaattttgtgtgtcgacgaacgtttgtggacagaggctggggcaatggctgtgggcttttcgggaaaggtagcctaataacgtgtgctaagttcaagtgtgtgacaaaactggaaggaaagatagttcaatatgagaacttgaaatattcagtaatagtcaccgtccacactggagaccagcaccaggtgggaaatgaaagcacagaacatgggacaacagcaattataacacctcaagctcccacgtcggaaatacagctgaccgactacggagctcttacattggattgctcacctagaacaggactagacttcaatgaaatggtgttgttgacaatgaaagaaaaatcatggctggtccacaaacaatggtttctagacctaccactgccttggacctcgggagctacaacgtcacaagagacttggaacagacaagatttgctggtaacattcaagacagctcatgcaaagaagcaggaagtagtcgtactaggatcacaagaaggagcaatgcacaccgcgttgaccggagcgacagaaatccaaacgtctggaacgacaacaatttttgcaggacacttgaaatgtagactaaaaatggacaaactgactctaaaagggatgtcatatgtgatgtgcacaggctcattcaagctagagaaagaggtggctgaaacccagcatggaaccgttctagtgcaggttaaatatgaaggaacagatgcaccatgcaagatccctttttcgacccaagatgaaaaaggagtaacccagaatgggagagtgataacagccaaccctatagtcactgacaaggaaaaaccagtcaacattgaggcagaaccaccttttggtgagagttacatcgtggtaggagcaggtgaaaaagctttgaaactaagctggttcaagaaaggaagcaccatagggaaaatgtttgaggcaactgcccgaggagcacgaaggatggccatattgggagacaccgcatgggactttggttccataggaggagtgttcacatctgttggaaaactagtacaccagatttttggaactgcatatggagtcttgttcagcggtgtttcctggaccatgaaaataggaataggggttctgctgacatggctaggattaaactcaaggagcacgtccctttcgatgacgtgcattgcagttggcctggtaacactgtacctaggagtcatggttcaggcggattcgggatgtgtgattaactggaaaggcagagaactcaaatgtggaagtggcatttttgtcaccaatgaagttcacacttggacagagcaatacaaatttcaggctgactccccaaaaagactgtcagcagccatcgggaaagcatgggaggagggtgtgtgtggaattcgatcagccactcgtctcgagaacatcatgtggaagcaaatatcaaatgaactgaaccacatcttacttgaaaatgacatgaaattcacagtggtcgtaggagatgttagtgggatcttggcccaagggaagaaaatgattaggccacaacccatggaacacaaatactcgtggaaaagctggggaaaagctaaaatcataggggcagatgtacagaactccaccttcatcattgacggcccaaacaccccagaatgccccgatgatcaaagagcatggaacatttgggaagttgaggactatggatttggaattttcacgacaaacatatggttgaaattgcgtgactcctacacccaagtgtgtgaccaccggctaatgtcagctgccatcaaggacagcaaggcagttcatgctgacatggggtactggatagaaagtgaaaagaacgagacttggaagctagcaagagcctccttcatagaagttaaaacatgcgtttggccaaaatcccacactctatggagcaatggagttctggaaagtgaaatgataattccaaagatatatggaggaccaatatctcagcacaactacagaccaggatatttcacacaaacagcagggccgtggcacttaggcaagttggaactagattttgatttgtgtgagggtaccacagttgttgtggatgaacattgtggaaatcgaggaccatctcttagaaccacaacagtcacaggaaaaataatccatgaatggtgctgcagatcctgtacgctaccacccttacgtttcaaaggagaagatgggtgttggtatggtatggaaattagaccagtcaaggaaaaggaagagaatctagttaaatcaatggtctctgcagggttaagagaagtggacagcttttcactaggactgctatgcatatcaataatgattgaagaggtgatgagatctagatggagcagaaaaatgctgatgactggaacactggttgtgttcctccttctcataatgggacaattgacatggaatgatctgatcaggttatgcatcatggttggagccaatgcttcagacaggatggggatgggaacaacgtacctagctctgatggccacttttaaaatgagaccaatgtttgctgtcgggctattattccgcagactaacatctagagaagttcttcttcttacaattggattgagtctagtggcatccgtggagctaccaaattccttggaggagctgggggatggacttgcaatgggcattatgatcttaaaattactgactgactttcagtcacatcagctgtgggctgccttgctgtccctgacatttatcaaaacaactttttctttgcattatgcatggaagacaatggctatggtactgtcaattgtgtctctcttccccttatgcatgtccacgacctctcaaaaaacaacatggcttccggtgctactgggatctcttggatgcaaaccactaaccatgtttctcatagcagaaaacaaaatctggggaaggaaaagttggcctctcaatgaaggaatcatggctgttggaatagtcagcatcttactaagttcactcctcaagaatgatgtgccactagctgggccactaatagctggaggcatgttaatagcatgttatgttatatctggaagctcagctgatttatcactagagaaagcggctgaggtctcctgggaagaagaagcagaacactctggtgcctcacacaatatattagtggaggtccaagatgatggaaccatgaagataaaagatgaagagagagatgacacactaaccattctccttaaagcaactctgctggcagtttcaggggtgtacccattatcaataccagcgaccctttttgtgtggtatttttggcagaaaaagaaacagagatcaggagtgttatgggacacacctagccctccagaagtggaaagagcagttcttgatgatggcatctatagaattatgcagagaggactgctgggcagatcccaagtaggggtaggagttttccaagaaaacgtgttccacacaatgtggcatgtcaccaggggagctgtactcatgtatcaagggaagagactggaaccgagttgggctagtgtcaaaaaagacctgatctcatatggaggaggttggaggcttcaaggatcctggaacacgggagaagaagtgcaggtgattgctgttgaaccagggaaaaaccccaaaaacgtacagacagcgccgggcaccttcaagacccctgaaggtgaagttggagccatagccctagattttaaacccggcacatctggatcccccatcgtgaacagagaggggaaaatagtaggtctttatggaaatggagtagtgacaacaagtggaacctacgtcagtgccatagctcaagctaaagcatcacaagaagggcccctaccagagattgaggacgaggtgtttaggaaaagaaacttaacaataatggacctacatccaggatcaggaaaaacaagaagatatcttccagccatagtccgtgaggccataaaaaggaagctgcgcacactaattttggctcccacaagagttgtcgcttccgaaatggcagaggcgctcaagggaatgccgattaggtatcagacaacagcagtgaagagtgaacacacaggaaaggagatagttgacctcatgtgccacgccactttcactatgcgtcttctgtctcccgtgagagttcccaattacaacatgattatcatggatgaagcacatttcaccgatccatccagcatagcggccagagggtacatctcaacccgagtgggtatgggtgaagcagctgcgatctttatgacagccactcccccaggatcagtggaggcctttccacagagcaatgcagttatccaagatgaggaaagagacattcctgagagatcatggaactcaggctatgattggatcactgacttcccaggcaaaacagtctggtttgttccaagcatcaaatcaggaaatgacattgccaactgtttaagaaagaatgggaaacgggtgattcaattgagcaggaaaacctttgacacagagtaccaaaagacaaaatacaacgactgggactatgtcgtcacaacagacatctccgaaatgggagctaacttccgagccgacagggtaatagacccaagacggtgtctgaaaccggtaatactaaaagatggtccagagcgtgtcattctagcaggaccgatgccagtgactgtggccagtgccgcccagaggagaggaagaatcggaaggaaccaaaataaggaaggtgatcagtacatctacatgggacagcctttaaacaacgatgaagaccacgctcattggacagaagcaaaaatgctccttgataatataaacacaccagaagggattatcccagccctctttgaaccggagagagaaaagagtgcggcaatagacggggaatatagactgcggggtgaagcaaggaaaacgtttgtggagctcatgagaagaggggatctacctgtctggctatcctataaagttgcctcagaaggcttccagtactctgacagaagatggtgttttgatggggaaaggaacaatcaggtgttggaggagaacatggacgtggagatctggacaaaagaaggagaaagaaagaaactacgaccccgctggcttgatgccagaacatactcagacccattggccctgcgcgagttcaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctacagacatgcaatggaagaactcccagacaccatagaaacgttgatgctcctagctttgatagctgtgttaactggtggagtgacgctgttcttcctatcaggaaggggcttagggaaaacatctatcggcctactttgcgtgatggcttcaagcgtgctgttatggatggccagtgtggagccccattggatagcggcctccatcatactggagttcttcctgatggtgctgcttattccagagccagacagacaacgcactccacaggacaaccagttggcatatgtagtgataggtttgttattcatgatactgacagtagcagccaatgagatgggattactggaaaccacaaagaaagacttagggattggccatgtggctgttgaaaatcaccaccacgccacaatgctggacgtagacttacatccagcttcagcctggaccctctatgcagtggccacaacaattatcacccccatgatgaggcacacaatcgaaaacacaacggcaaatatttccctgacagctattgcaaaccaggcagccatattgatgggactcgacaaaggatggccaatatcgaagatggacataggagttccacttctcgccttggggtgctattcccaggtgaatccactgacgctgacagcggcagtattgatgctagtggctcattacgccataattggacctggactgcaagctaaagctactagagaagcccaaaaaaggacagcggccggaataatgaagaatccaactgtcgatggaatagttgcaatagatttggaccctgtggtttatgatgcaaaatttgagaaacaactaggccaaataatgttgttgatactatgcacatcacagatcctcttaatgcggactacatgggccttgtgtgaatccatcacactggctactggacctctgaccacgctttgggagggatctccaggaaaattttggaacactacgatagccgtgtccatggcaaacatattcaggggaagttatctagcaggagcaggcctggccttctcactaatgaaatctctaggaggaggtaggagaggtacgggagcccaaggggaaacactgggagaaaaatggaaaagacagctaaaccaactgagcaagtcagaattcaacacttataaaaggagtgggattatagaagtggatagatccgaagccaaagagggactgaaaagaggagaaacaaccaaacatgcagtgtcgagaggaaccgccaaactgaggtggtttgtggaaaggaaccttgtgaaaccagaagggaaagtcatagacctcggttgtggaagaggtggctggtcatattattgcgccgggctgaagaaagtcacagaagtgaagggatacacaaaaggaggagctggacatgaggaaccaatcccaatggcgacctatggatggaacctagtaaagctatactccgggaaagacgtattctttacaccacctgaaaaatgtgacacccttttgtgtgacattggtgagtcctctccgaacccaaccatagaagaaggaagaacgttacgtgtcctaaagatggtggaaccatggctccgaggaaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacttaggcgctggaacaagacatgtggcagtggaaccagaggtagccaacctagatatcattggccagaggatagagaacataaaacatgaacataagtcaacatggcattatgatgaggacaatccatacaagacatgggcctatcatggatcatatgaggtcaagccatcaggatcagcctcatctatggtcaatggcgtggtgagactgctcaccaaaccatgggatgtcattcccatggtcacacaaatagccatgactgacaccacaccctttggacaacagagggtgtttaaagagaaagttgacacgcgcacaccaaaagcgaaacaaggcacagcacaagtcatggaggtgacagctaggtggttatggggttttctttctagaaacaaaaaaccaagaatctgcacaagagaggagttcacaagaaaagttaggtcaaacgcagccattggagcagtgttcgttgatgaaaatcaatggaactctgcaaaagaagcagtggaagatgagcggttttgggaccttgtgcacagagagagggagcttcacaaacagggaaaatgtgccacatgtgtttacaatatgatgggaaaaagagagaaaaaactaggagagttcggaaaggcaaaaggaagtcgtgcaatatggtacatgtggttgggagcacgctttctagagtttgaagcccttggtttcatgaacgaagatcactggttcagtagagagaattcactcagtggagtggaaggagaaggactccacagactcggatatatactcagagacatatcaaagattccagggggaaatatgtatgcagatgacacagccggatgggatacaaggataacagaggatgatcttcagaatgaagccaaaatcactgacatcatggagcccgaacatgccctactggctacgtcaatcttcaagctgacctaccaaaataaggtggtgagggtgcagagaccagcaaaaaatggaaccgtgatggatgttatatccagacgtgaccagagaggaagtggccaggtcggaacttatggcttaaacactttcaccaacatggaggctcagctaataagacaaatggagtctgagggaatcttttcacccagcgaattagagaccccaaatttggccaagagagttctcgactggttggaaaaatatggcgtcgaaaggctgaaaagaatggcaatcagcggagatgactgcgtggtgaaaccaattgatgacaggttcgcaacagccctaacagctctgaacgatatgggaaaagtaagaaaagacataccacaatgggaaccttcaaaaggatggaatgactggcaacaagtgcctttttgttcacaccatttccaccagctgattatgaaggatgggagggaaatagtggtgccatgccgcaaccaagatgaacttgtgggtagagctagagtgtcacaaggtgccggatggagcctgagagaaactgcatgcctgggcaagtcatatgcacaaatgtggcagctgatgtacttccacaggagagacctgagactagctgctaatgccatctgttcagccgttccagttgattgggtcccaaccagccgcaccacttggtcgatccatgcccatcatcaatggatgacaacagaaaacatgttgtcagtgtggaatagggtttggatagaggaaaacccatggatggaggacaaaacccatgtgtccagttgggaagatgttccatatttagggaaaagggaagatcagtggtgtggttccctgataggcttaacagcaagggccacctgggccactaacatacaagtggccataaaccaagtgagaaggctaattgggaatgagaattatctagattatatgacatcaatgaagagattcaagaacgatagcgatcccgaaggggcactctggtga

SEQ ID NO: 29 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaactggtgatggctttcatagcattcctaagatttctagccatacctccaacagcaggaattttggctagatggagctcattcaaaaagaatggagcgatcaaagtgttacggggtttcaagaaagaaatctcaaacatgttgaacataatgaacaggaggaaaagatctgtgaccatgctcctcatgctgctgcccacagtcctgacgttccatctgaccacccgagggggagagccgcacatgatagttagcaagcaggaaagaggaaagtcacttttgtttaagacctctgcaggtgtcaacatgtgcacccttattgcaatggatctgggagagttatgtgaggacacaatgacctacaaatgccctcggatcactgaaacggaaccagatgacgttgactgttggtgcaatgccacggagacatgggtgacctatggaacatgttctcaaactggtgaacatcgacgagacaaacgttctgtcgcactagcaccacacgtagggcttggtctagaaacaagaaccgaaacgtggatgtcctctgaaggcgcttggaaacaaatacaaaaagtggagacatgggctctgagacacccaggattcacggtgatagccctttttctagcacatgccataggaacatccatcacccagaaaggaattattttcattttgctgatgctggtaactccatccatggccatgcggtgcgtgggaataggaaacagagacttcgtggaaggattgtcaggagctacgtgggtggatgtggtgctggagcatggaagttgcgtcaccaccatggcaaaagacaaaccaacgctggacattgaacttttaaagacggaggtcacaaaccctgccgtcctgcgcaaattgtgcattgaagctaaaatatcaaacaccaccactgattcgagatgtccaacacaaggagaggccacgctagtggaagaacaagacacgaactttgtgtgtcgacgaacgttcgtggacagaggctgggggaatggttgtggactattcggaaaaggcagcttaataacgtgcgtcaagtttaagtgtgtgacaaaattggaaggaaagatagtccaatatgaaaacctaaaatattcagtgatcgttaccgtccacactggagaccagcaccaagttggaaatgagaccacagaacatggaacaattgcaaccataacacctcaagctcccacgtcagaaatacagctgacagactacggagctctaacactggattgctcacccagaacagggctagactttaatgagatggtgttgttgacaatgaaagaaaaatcatggctcgtccacaaacaatggtttctagacttaccactgccttggacctcaggggcttcaacatcccaagagacttggaatagacaagacttgctggtcacatttaagacagctcatgcaaagaagcaagaagtagtcgtactaggatcacaagaaggagcaatgcatactgcgttgactggagcgacagaaatccaaacgtctggaacgacaacaatttttgcaggacatctgaaatgtaggttaaaaatggataagctgactttaaaaggaacatcatatgtaatgtgcacaggcccattcaagttagagaaggaagtggctgagacccagcatggaactgttctagtacaggtcaaatacgaaggaacagatgcaccatgcaagatccccttctcgtcccaagatgagaagggagtaacccagaatggaagattgataacagccaaccccatagtcactgacaaagaaaaaccaatcaacattgaggcagagccaccctttggtgagagctacatcgtggtaggagtaggtgaaaaagctttgaaactaagctggttcaagaagggaagcagtatagggaaaatgtttgaagcaactgcccgtggagcacgaagaatggccattctgggagacaccgcatgggacttcggttctataggaggagtgttcacgtctatgggaaaactggtacaccagatttttggaactgcttatggagtcttattcagcggtgtttcttggaccatgaaaataggaatagggattctgctgacatggctaggactgaactcaaggagcacgtccctttcaatgacgtgtatcgcagtaggcatggtcacactgtacctaggagtcatggtccaggcggactcgggatgtgtaatcaattggaaaggcagagaactcaaatgtggaagcggcatttttgtcaccaatgaagttcatacctggacagagcaatacaaattccaggccgactccccaaagagactatcagcagccattgggaaggcatgggaggagggtgtgtgtggaattcgatcagccactcgtcttgagaacatcatgtggaagcaaatatcaaatgaattaaaccacatcttacttgaaaatgacatgaaatttacagtagtcgttggagacgtcagtgggatcttggcccaagggaagaaaatgattaggccacaacccatggaacacaaatactcgtggaaaagctggggaaaagccaaaatcataggagcagatgtacagaacactaccttcatcatcgacggcccaaataccccagaatgctctgatgaccaaagagcatggaacatctgggaagttgaagactatggatttggaatcttcacgacaaacatatggttgaaactgcgtgactcctacacccaagtgtgtgaccaccgactaatgtcagctgccatcaaggatagcagagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagatatatggaggaccaatatctcagcacaattacagaccaggatacttcacacaaacagcagggccgtggcacttaggcaagttggaactggattttgatttgtgtgaaggtaccacagttgtcgtggatgaacaatgtggaaatcgaggaccatcccttagaaccacaacagtcacaggaaagataatccatgaatggtgctgtagatcttgcacattaccccccctacgcttcaaaggagaagacgggtgctggtacggtatggaaattagaccagtcaaggagaaggaagagaacctagtcaagtcaatggtctctgcagggtcaggagaagtggacagtttttcactaggactgttatgcatatcaataatgatcgaagaggtaatgagatccagatggagcagaaaaatgctgatgactggaacattggctgtgttcctccttctcacaatgggacaattaacatggaatgatctaatcaggctatgtatcatggttggagccaatgcttcagacaagatggggatgggaacaacgtacttggctttgatggccactttcagaatgagaccaatgttcgcagttgggctattattccgcggattaacatccagagaagttctccttctcacagttggattgagcttggtggcatctgtagaactaccaaattccctagaggagctaggggatggacttgcaatgggcattatgatgttaaaattactgactgattttcaatcacaccagctatgggctaccttgctgtctttaacatttgtcaaaacaactttttcattgcactatgcatggaagacaatggctatgacactgtcaattgtatctctcttccctttgtgcctgtccacgacctcccaaaaaacaacatggcttccggtgctgctgggatctcttggatgcaaaccattaaccatgtttctcataacagaaaataaaatctggggaaggaaaagttggcctctcaatgaaggaattatggctgttggaatagttagcatcctactaagttcacttctcaaaaatgatgtgccactagctggcccattaatagctggaggcatgctgatagcatgttatgtcatatccggaagctcggctgatctatcactggagaaagcggctgaggtctcttgggaagaagaagcagaacactctggtgcctcacataacatactagtagaggtccaagatgatggaaccatgaagataaaggatgaagagagagacgatacaatcaccatcctcctcaaagcaactttgctagcaatctcaggggtatacccaatgtcaataccggcgactctctttgtgtggtatttttggcagaaaaagaaacagagatcaggagtgctatgggacacacccagccctcctgaagtggaaagagcagtccttgacgatggtatttatagaattctccaaagaggattattgggcaggtctcaagtaggagtaggagtttttcaagaaggcgtattccacacaatgtggcacgtcaccaggggagctgtcctcatgtaccaagggaagagattggaaccaagttgggccagtgtcaaaaaagacctgatctcatatggaggaggttggaggtttcaaggatcctggaacacgggagaagaggtgcaggtgattgctgttgaaccggggaagaacccaaaaaacgtacagacagcgccgggtaccttcaagacctctgaaggcgaagttggagccatagctctagactttaaacctggcacatctggatctcctatcgtgaacagagagggaaaaatagtgggtctttatggaaacggagtggttacaacaagtggaacctatgtcagtgcaatagctcaagctaaagcatcacaagaagggcctctaccagagattgaggacgaggtgtttaggaaaagaaacttaacaataatggacctacatccaggatcgggaaaaacaagaagataccttccagccatagtccgtgaggccataaaaagaaagctgcgcacgctagtcttagctcctacaagagttgttgcttctgaaatggcagaggcgctcaagggaatgccaataaggtaccagacaacagcagtgaagagtgaacacacgggaaaggaaatagttgacctcatgtgccacgccactttcaccatgcgcctcctgtctcctgtgagagttcccaactacaacatgattattatggatgaagcacatttcaccgatccagccagcatagcagccagagggtacatctcaacccgagtgggtatgggtgaagcagctgcgattttcatgacagccactccccccggatcggtggaggcctttccacagagtaatgcagttattcaagatgaggaaaaagacattcctgaaagatcatggaactcaggctatgactggatcactgactttccaggcaaaacagtctggttcgttccaagcatcaaatcaggaaatgacatcgctaactgtttaagaaagaatgggaaacgggtgatccaattgagcagaaaaacctttgacactgagtaccagaaaacaaaaaacaatgactgggactatgttgtcacaacagatatatctgaaatgggagcaaactttcgagccgacagggtaatagacccaaggcggtgtctgaaaccagtaatactgaaagatggcccagagcgcgtcattctagccggaccaatgccagtgactgtggctagtgccgcccagaggagaggaagaattggaaggaaccaaaataaagaaggtgatcagtatatttacatgggacagcccctgaacaatgatgaggaccacgcccattggacagaagcaaaaatgctacttgacaacataaacacaccagaagggattatcccagccctctttgagccggaaagagaaaagagtgcagcaatagacggggaatacagactacggggcgaagcgaggaaaacattcgtggagctcatgagaagaggagacctacctgtctggctatcttacaaagttgcctcagaaggcttccaatactccgacagaaggtggtgctttgatggggaaaggaacaaccaggtgttggaggagaacatggatgtggagatctggacaaaagaaggagaaagaaagaaactacgaccccgctggctggacgccagaacatactctgacccactggctctgcgcgaattcaaagagttcgcagcaggaagaagaagcgtctcaggtgatctaatattagaaatagggaaacttccacaacatttaacgcaaaaagcccagactgctttggacaatctggtcatgctgcacaactctgaacaaggaggaaaagcctatagacacgccatggaagaactaccagacaccatagagacgttaatgctcctagctttgatagctgtgctgactggtggagtgacgctgttcttcctatcaggaaaaggcctagggaaaacatccattggcctactctgcgtgatgtcctcaagtgcactgttatggatggccagtgtggagccccattggatagcggcctctattatactggagttctttctgatggtgttgcttattccagagccagatagacagcgcactccacaagataaccagctagcatatgtggtgataggtttgctattcatgatattgacagtggcagccaatgagatggggttattggaaaccacaaagaaagacctggggattggccatgcagctgctgaaaaccaccaccacgctgcaatgctggacgtagacctacatccagcttcagcctggactctctacgcagtggccacaacgattattactcccatgatgagacatacaatcgaaaacacaacggcgaatatttccctgacagctattgcaaaccaggcagccatattgatgggacttgataagggatggccaatatcaaaaatggacataggagttccacttctcgctttggggtgctattctcaggtgaacccgctgacgctgacagcggcggtattgatgctagtagctcattatgccataattggacctggactgcaagcaaaagccacaagagaagctcaaaaaaggacagcagccggaataatgaaaaacccaaccgtcgacgggattgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacaatagcggtgtccatggcaaacatttttagaggaagttacctagcaggagcgggtctggccttctcattaatgaaatctctaggaggaggtaggagaggcacaggagcccaaggggaaacactgggagaaaaatggaaaagacagctaaaccaactgagcaagtcagaatttaacacttacaagaggagtgggatcatggaggtggatagatctgaagccaaagaggggttgaaaagaggagagacaaccaaacacgcagtgtcgagaggaacagccaaactgagatggttcgtggagaggaaccttgtgaaaccagaaggaaaagtcatagacctcggttgtggaagaggtggctggtcatattattgcgctgggctaaagaaagtcacagaagtgaaaggatacacaaaaggaggacctggacatgaggagccaatccccatggcaacctatggatggaacctagtaaagttacattccgggaaggatgtattcttcataccacctgagaaatgtgacacccttttgtgtgatattggtgagtcctctccgaacccgaccatagaagaaggaagaacgttacgtgttctaaaaatggtggaaccatggctcagaggaaaccaattttgcataaaaattttaaatccctacatgccgagtgtggtagaaaccctggagcaaatgcaaagaaaacatggaggaatgctagtgcgaaatccactctcaagaaattccactcatgaaatgtactgggtttcatgtggaacaggaaacattgtgtcagcagtaaacatgacatctagaatgctgctaaatcgattcacaatggcacacaggaaaccaacatatgaaagagatgtggacttaggcgctggaacaagacatgtggcagtagaaccagaggtagccaacctagatatcattggccagaggatagagaatataaaaaatgaacacaagtcaacatggcattatgatgaggacaatccgtacaaaacatgggcctatcatggatcatatgaggttaggccatcaggatcagcctcatccatggttaatggtgtggtgagactgctaaccaaaccatgggatgttattcccatggtcacacaaatagccatgactgacaccacaccctttgggcaacagagggtgtttaaagagaaagttgacacacgtacaccaaaagcgaaacgaggcacagcacaaattatggaggtgacagccaagtggttatggggtttcctctccagaaacaaaaaacccagaatctgcacaagagaggaatttacaaggaaagtcaggtcaaatgcagctattggagcggtgttcgttgatgaaaatcaatggaactcagcaaaagaggcagtggaagatgaacggttctgggaccttgtgcacagagagagggagcttcataaacaaggaaagtgtgccacgtgtgtctacaacatgatgggaaagagagagaaaaaactaggagagttcggaaaggcaaaaggaagtcgcgcaatatggtacatgtggttgggagcgcgcttcctagagtttgaagccctcggcttcatgaatgaagatcactggttcagcagagagaattcactcagtggagtggaaggagaaggactccacaaacttggatacatactcagagacatatcaaagattccagggggaaatatgtatgcagatgacacagccggatgggacacaagaataacagaggatgatcttcagaatgaagccaagatcactgacatcatggaacctgaacatgccctactggccacgtcaatcttcaagctaacctaccaaaacaaggttgtgagggtgcagagaccagcaaaaagtggaactgtgatggatgtcatatccaggcgtgatcagagaggaagtggacaggttgggacctatggtttgaacaccttcaccaacatggaggcccaactaataagacaaatggagtccgagggaatcttttcacccagcgaactggaaaccccaaatctagccggaagagtcctcgactggttggaaaaacatggcatcgagaggctgaaaagaatggcaatcagcggagatgactgtgtggtgaaaccaattgatgacagatttgcaacagctttaacagctttgaatgacatggggaaggtaagaaaagacataccgcaatgggaaccttcaaaaggatggaatgattggcaacaggtgcctttctgctcacaccattttcatcagctgattatgaaggatgggagggaaatagtggtgccatgccgcagccaagatgaacttgtaggtagggccagagtatcgcaaggtgccggatggagcttgagagaaactgcatgtctaggcaagtcatatgctcaaatgtggcagctgatgtacttccacaggagagacttgagattagcagctaatgccatctgttcagccgttccagttgattgggtcccaaccagccgcaccacctggtcgatccatgcccaccatcaatggatgactacagaagacatgttgtcagtgtggaatagggtttggatagaggaaaacccatggatggaggacaaaactcatgtgtccagttgggaagacgttccatacctagggaaaagggaagatcaatggtgtggatccctaataggcctaacagcacgagccacctgggccactaacatacaagttgccataaaccaagtgagaaggctcatcgggaatgagaattatctagactacatgacatcaatgaagagattcaaaaacgagagtgatcccgaaggggcactctggtaa

SEQ ID NO: 30 - DNA, 10179 bp, Dengue virus
atgaacaaccaacggaagaagacgggtcgaccgtctttcaatatgctgaaacgcgcgagaaaccgcgtgtcaactggttcacagttggcgaagagattctcaaaaggattgctctcaggccaaggacccatgaaattggtgatggcttttatagcattcctaagatttctagccatacccccaacagcaggaattttggctagatggagctcattcaagaagaatggagcgatcaaagtgttacggggtttcaaaaaagagatctcaagcatgttgaacataatgaacaggagaaaaagatccgtgaccatgctccttatgctgctgcccacagccctggcgtttcatttgaccacacgagggggagagccacacatgatagttagcaagcaggaaagaggaaagtcactcttgtttaagacctctgcaggtgtcaacatgtgcaccctcattgcaatggatttgggagagttatgtgaggacacaatgacctacaaatgcccccggatcactgaagcggaaccagatgatgttgattgctggtgcaatgccacagacacatgggtgacctatgggacgtgttctcaaactggcgaacaccgacgggataaacgttctgtcgcactggccccacacgtggggcttggtctagaaacaagaaccgaaacgtggatgtcctctgaaggcgcctggagacagatacaaaaagtggagacttgggccttgagacacccaggattcacggtgatagccctttttctagcacataccataggaacatccatcacccagaaagggattatcttcattttgctgatgctggtgacaccatcaatggccatgcgatgcgtgggaataggcaacagagacttcgttgaaggactgtcaggagcaacgtgggtggatgtggtactggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgcccaacacaaggagaagctacactggtggaagaacaagacgcgaactttgtgtgtcgacgaacattcgtggacagaggctggggtaatggctgtggactattcgggaaaggaagcttactgacgtgtgctaagtttaagtgtgtgacaaaacttgaaggaaagatagttcaatatgaaaacttaaaatattcggtgatagtcactgtccacactggggaccagcaccaggtgggaaatgagaccacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccactgccttggacctcgggggcttcaacatctcaagagacttggaacagacaagatttgctggtcacatttaagacagctcatgcaaagaagcaggaagtagtcgtactggggtcacaagaaggagcaatgcacactgcgttgactggggcgacagaaatccagatgtcaggaacgacgacaatcttcgcaggacacctgaaatgtagactaaaaatggataaactgactttaaaaggggtgtcatatgtgatgtgcacaggctcatttaagttagagaaggaagtggctgagacccagcatggaaccgtcctagtgcaggttaaatacgaaggaacagatgcaccatgcaagattcccttttcaacccaagatgagaaaggagtgacccagaatgggagattgataacagccaatcccatagttactgacaaagaaaaaccagtcaacattgagacagaaccaccttttggtgagagctacatcgtgataggggcgggtaaaaaagctttgaaactaagctggttcaagaaaggaagcagcatagggaaaatgttcgaagctaccgcccgaggagcacgaaggatggctatcctgggagacacagcatgggacttcggttccatgggaggggtgttcacatctgtgggaaaattggtacaccaggtttttggaaccgcatatggggttttgttcagcggtgtttcttggaccatgaaaataggaatagggattctgctgacatggctaggattaaattcaaggagcacgtcactctcgatgacgtgcattgcagttggcatggtcacactgtacctaggagtcatggttcaagcggactcggggtgtgtgatcaactggaagggcagagaactcaaatgtggaagtggcatcttcgtcactaatgaagtccacacttggacagagcaatataaattccaggctgactccccaaaaagactgtcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgctaatggaatcttgacccaaggaaaaaagatgattaggccacaacccatggaacacaaatactcatggaaaagctggggaaaagccaaaatcataggagcagacatacagaataccaccttcatcatcgatggcccagacactccagaatgccccgatgaccagagagcatggaacatttgggaagttgaggactatgggtttggaattttcacgacaaacatatggctgaaattgcgtgactcctacacccaaatgtgtgaccaccggctaatgtcagctgccatcaaggacagtaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttgatttgtgtgaaggcaccacagttgttgtggatgaacattgtggaaatcgaggtccatctcttagaactacaacagtcacaggaaagataatccatgaatggtgttgcagatcctgcacgctaccccccttacgcttcaaaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacaggatggggatgggaacaacgtacctagccttgatggccactttcaaaatgagaccgatgttcgctgttgggctattatttcgcagactaacatccagagaggttctccttctcacaattggactaagcctggtggcatccgtggagctaccaaattctttagaggagctaggggacggacttgcaatgggcatcatgatgttaaaattattgactgattttcagtcacaccagttatggactaccttactgtctctgacatttatcaaaacaactctttcattggattatgcatggaagacaatagctatggtactgtcaatcgtatctctctttcctttatgtctatctacgacctctcaaaaaacaacatggcttccggtgctgttaggatcttttggatgcaaaccactaaccatgtttcttataacagaaaacaaaatctggggaaggaaaagttggcccctcaatgaaggaattatggctgttggaatagtcagcattttactaagttcactcctcaaaaatgatgtgccactagccggcccactaatagctggaggcatgctaatagcatgttacgtcatatccggaagctcagccgatttatcattggagaaagcggctgaggtctcctgggaagaagaagcagaacactctggtgcctcacacaacatactagtggaggtccaagatgatggaactatgaaaataaaagatgaagagagagatgacacgctcactatactccttaaagcaactctgttggcagtctcaggggtgtacccaatgtcaataccagcaaccctttttgtgtggtatttttggcagaaaaagaaacagagatcaggagtcttgtgggacacacccagccctccagaagtggaaagagcagttcttgatgatggtatctatagaatcttgcaaagaggactgttgggtaggtcccaagtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgagccaggaaaaaacccaaaaaatgtacagacaacgccgggcaccttcaagacccctgaaggcgaagttggagccatagccctagattttaaacccggcacatctggatctcccatcgtgaacagagagggaaaaatagtaggtctttatggaaatggagtggtgacaacaagtggaacctacgtcagtgccatggcccaagctaaagcatcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaagggagatagttgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggtaaaacagtctggtttgttccaagcatcaaatcaggaaatgacattgccaactgtttaagaaagaacgggaaacgggtgatccaattgagcagaaaaacctttgacactgaataccagaaaacaaaaaacaatgactgggactatgttgtcacaacagacatttccgaaatgggagcaaatttccgggccgacagggtaatagacccaaggcggtgcttgaagccggtaatactaaaagatggcccagagcgcgtcattctagccggaccaatgccagtgaccgtggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaacacgccagaagggattatcccagccctctttgagccggagagagaaaagagtgcagcaatagacggggagtacagactgcggggagaagcaaggaaaacgttcgtggagctgatgagaagaggggatctaccagtttggctatcttacaaagttgactcagaaggcttccagtactccgacagaaggtggtgctttgacggggaaaggaacaaccaggtgttggaggagaacatggacgtggagatctggacaaaagaaggagaaagaaagaaattacgacctcgctggttagatgccagaacctactctgatccactggccctgcgcgagtttaaagagttcgcagcaggaagaagaagtgtctcaggtgacctaatattagaaatagggaaacttccacagcatttgacgctaagggcccagaatgctttggacaacttggtcatgttgcacaattccgaacaaggaggaaaagcctatagacatgctatggaagaactaccagacaccatagaaacattgatgctcctagctttgatagctgtgctgactggtggagtgacgttgtttttcctatcaggaaaaggtctagggaaaacatccattggcctactttgtgtgatggcctcaagtgtactgttatggatggccagtgtggagccccattggatagcggcctccatcatactagagttctttctgatggtgctgctcattccagagccagacagacagcgtactccacaggacaatcagctagcatatgtggtgataggtttgttattcatgatattgacagtggcagccaatgagatgggattactggaaaccacaaagaaagacctggggattggccatgtagtcgccgaaaaccaccaccatgctacaatgctagacatagacttacatccagcttcagcctggaccctctatgcagtagccacaacaattatcactcccatgatgagacacacaattgaaaacacaacggcaaatatttccctgacagctattgcaaatcaggcggctatattgatgggacttgacaagggatggccaatatcgaagatggacataggagtgccacttctcgccttagggtgctattcccaggtgaacccattgacactgacagcggcggtgttgatgttagtggctcattatgccataatcggacctggactgcaagcaaaagctactagagaagcccaaaaaaggacagcggccggaataatgaaaaatccaactgtagacgggattgttgcaatagatttggatcctgtggtttacgatgcaaaatttgaaaaacagctaggccaaataatgttactgatactttgcacatcacagattctcttgatgcggactacatgggccttatgtgaatccatcacactggctactggacccttgaccactctctgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacattgggagaaaaatggaaaagacaactaaaccaactgagcaagtcagaattcaacacttacaaaaggagtggaattatggaggtggacagatctgaagccaaggagggactgaaaagaggagaaacaaccaaacatgcagtgtcgagaggaacagccaaacttaggtggtttgtggagaggaaccttgtgaaaccagaagggaaagtgatagacctcggttgtggaagaggtggctggtcatattattgcgctgggctgaagaaggttacagaagtgaagggatacacaaaaggaggacccggtcatgaggaacctatcccaatggcgacttatggatggaacctagtgaagctatactccggaaaagatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgttgctgaatcggttcacaatggctcacaggaagccaacatatgaaagagacgtggacttgggcgctggaacaagacatgtggcagtggaaccagagatagccaacctagacatcattggccagaggatagagaacataaaaaatgaacataagtcaacatggcatcatgatgaggacaatccatacaaaacatgggcctatcatggatcatatgaggtcaagccatcaggatcagcctcatccatggtgaatggcgtggtgagactgctcaccaaaccatgggatgttatccccatggtcacacaaatagctatgactgataccacacccttcggacaacagagggtgtttaaagagaaagttgacacacgcacaccaagaccaaaacgaggcacagcacaaattatggaggtgacagccaagtggttgtggggtttcctctctagaaataaaaaacccagaatctgcacaagagaggagttcacaagaaaagttaggtcaaacgcagcaattggagcagtgttcgttgatgaaaaccaatggaactcagcaaaagaagcagtggaagacgaaaggttttgggacctcgtgcacagagagagggagcttcataaacagggaaaatgtgccacgtgtgtctacaatatgatggggaaaagagagaaaaaattaggagagtttggaaaggcaaaaggaagtcgtgcaatatggtacatgtggttgggagcacgctttctagagtttgaagcccttggcttcatgaatgaagaccactggttcagtagagagaattcactcagtggagtggaaggagaaggactacacaaacttggatacatactcagagacatatcaaagattccagggggaaatatgtatgcagatgacacagctggatgggacacaagaataacagaggatgatcttcagaatgaggctaaaatcactgacatcatggagcccgaacatgctctactggctacgtcaatcttcaagctgacctatcaaaataaggtggtaagggtgcaaagaccagcaaaaagtggaaccgtgatggatgttatatccagacgtgaccagagaggaagtggacaggtcggaacttatggcttaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagctctgaatgacatgggaaaagtaagaaaagacataccgcaatgggaaccttcaaaaggatggaatgactggcagcaagtgcctttctgttcacaccatttccaccagctgatcatgaaggatgggagggagatagtggtgccatgtcgcaaccaagatgaacttgtgggcagggccagagtatcacaaggcgccggatggagcctgagagaaactgcttgcctaggcaagtcatatgcacaaatgtggcagctgatgtacttccacaggagagacctgagactggcggccaatgctatctgttcagccgttccagttgattgggtcccaaccagccgcaccacctggtcgatccatgcccaccaccaatggatgacaacagaagacatgttatcagtgtggaatagggtttggatagaggaaaacccatggatggaggacaaaactcatgtatccagttgggaagatgttccatacttaggaaaaagggaagatcaatggtgtggatccctgataggcttaacagcaagggccacctgggccaccaacatacaagtggccataaaccaagtgagaaggctcattgggaatgagaattatttagactacatgacatcaatgaagagattcaagaatgagagtgatcccgaaggagccctctggtaa

SEQ ID NO: 31 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagttggcccctcaatgaagggatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtaacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcgatcttcatgacagccactcccccaggatcaatggaggcctttccacagagcaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaagggcctagggaaaacatctatcggcctactctgcgtgatggcttcaagcgtactgctatggatggccagtgtggagccccattggatagcggcctccatcatactggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaggtggttatggggttttctctctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggggcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgtcccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 32 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgattaaagtgttacggggtttcaagaaagaaatctcaaacatgttgaatataatgaatagaaggaagagatccgtgaccatgctccttatgttgctgcccacagccttggcgtttcatctgaccacacgagggggagagccgcatatgatagttaccaagcaggaaagaggaaagtcacttttgtttaagacctcagctggtgtcaacatgtgcacccttattgcgatggatttgggagagttatgtgaggacacaatgacttacaaatgccctcgaatcactgaggcggaaccagatgacgttgattgttggtgcaatgccacagacacatgggtgacctatggaacgtgttcccaaactggcgagcaccgacgagacaaacgttccgtcgcactggccccacacgtgggacttggtctagaaacaagaaccgaaacgtggatgtcctctgaaggtgcttggaaacaaatacaaagagtggagacttgggccctgagacacccaggattcacagtgatagccctttttctagcacatgccataggaacatccatcacccagaaagggattattttcattttgttgatgctggtaacaccatccatggccatgcgatgtgtgggaataggcaacagggacttcgtggaaggactgtcaggagcaacgtgggtagatgtggtactggaacatggaagttgcgtcaccaccatggcaaaagataaaccaacattggacattgaactcttgaagacggaagtcacaaaccctgccgttctgcgcaaactgtgcatcgaagctaaaatatcaaacaccaccaccgattcaagatgtccaacacaaggagaagccacactggtggaagaacaagacgcgaattttgtgtgtcgacgaacgtttgtggacagaggctggggcaatggctgtgggcttttcggaaaaggtagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaacagcaactataacacctcaagctcccacgtcggaaatacagctgaccgactacggagctcttacattggattgctcacctagaacaggactagacttcaatgaaatggtgttgttgacaatgaaagaaaaatcatggctagtccacaaacaatggtttctagacctaccactgccttggacctcgggagcttcaacgtcacaagagacttggaacagacaagatttgctggtaacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaaaatggacaaactgactctaaaagggatgtcatatgtgatgtgcacaggctcattcaagctagagaaagaggtggctgagacccagcatggaaccgttctagtgcaggttaaatacgaaggaacagatgcaccatgcaagatccctttttcgacccaagatgagaaaggagtaacccagaatgggagagtgataacagccaaccctatagtcactgacaaggaaaaaccagtcaacattgaggcggaaccaccttttggtgagagttacatcgtggtgggagcaggtgaaaaagctttgaaactaagctggttcaagaaaggaagcagcatagggaaaatgtttgaggcaactgcccgaggagcacgaaggatggccatactgggagacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagtacgtccctttcgatgacgtgcattgcagttggcctggtaacactgtacctaggagtcatggttcaggcggattcgggatgtgtaattaattggaaaggcagagaactcaaatgtggaagtggcatttttgtcaccaatgaagttcacacttggacagagcaatacaaatttcaggctgactccccaaagagactatcagcagccatcgggaaggcatgggaggagggtgtgtgtggaattcgatcagccactcgtctcgagaacatcatgtggaagcaaatatcaaatgaactgaaccacatcttacttgaaaatgacatgaaattcacagtggttgtaggagatgttagtgggatcttggcccaagggaaaaaaatgattaggccacaacccatggaacacaaatactcgtggaaaagctggggaaaagctaaaatcataggggcagatgtacagaactccaccttcatcatcgacggcccaaacaccccagaatgccccgatgatcaaagagcatggaacatttgggaagttgaggactatggatttggaattttcacgacaaacatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcgagagcctccttcatagaagttaaaacatgcgtctggccaaaatcccacactctatggagcaatggagttctggaaagtgaaatgataattccaaagatatatggaggaccaatatctcagcacaactacagaccaggatatttcacacaaacagcagggccgtggcacttaggcaagttggaactagattttgatttgtgtgagggtaccacagttattgtggatgaacattgtggaaatcgaggaccatctcttagaaccacaacagtcacaggaaaaataatccatgagtggtgctgcagatcttgtacgctaccacccttacgtttcaaaggagaagatgggtgttggtacggtatggaaattagaccagtcaaggaaaaggaagagaatctagtcaaatcaatggtctctgctgggttaggagaagtggacagcttttcactaggactgctatgcatatcaataatgatcgaagaggtgatgagatctagatggagtaggaaaatgctgatgactggaacactggctgtgttcctccttctcataatgggacaattgacatggaatgatctgatcaggttatgcatcatggttggagccaatgcttcagacaggatggggatgggaacaacgtacctagctctgatggccacttttaaaatgagaccaatgtttgctgtcgggctattattccgcagactaacatctagagaagttcttcttcttacaattggattgagtctagtggcatccgtggagctaccaaattccttggaggagctgggggatggacttgcaatgggcattatgatcttaaaattactgactgactttcagtcacatcagctgtgggctgccttgctgtccctgacatttatcaaaacaacttattctttgcactatgcatggaagacaatggctatggtactgtcaattgtgtctctcttccccttatgcctgtccacgacctctcaaaagacaacatggcttccggtgctattgggatctcttggatgcaaaccactaaccatgtttcttatagcagaaaacaaaatctggggaaggaaaagttggcctctcaatgaaggaattatggctgttggaatagtcagcatcttactaagttcactcctcaaaaatgatgtgccgctagctgggccactaatagctggaggcatgctaatagcatgttatgttatatctggaagctcagccgatttatcactagagaaagcggctgaggtctcctgggaagaagaagcagaacactctggtgcctcacacaatatattagtggaggtccaagatgatggaaccatgaagataaaagatgaagagagagatgacacactaaccattctccttaaagcaactctgctggcagtttcaggggtgtacccactatcaataccagcgaccctttttgtgtggtatttttggcagaaaaagaaacagagatcaggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagttgggctagtgtcaaaaaagacctgatctcatatggaggaggttggaggcttcaaggatcctggaatacgggagaagaagtgcaggtgattgctgttgaaccagggaaaaaccccaaaaatgtacagacagcgccgggcaccttcaagacccctgaaggtgaagttggagccatagccctagattttaaacccggcacatctggatctcccattgtgaacagagaggggaaaatagtaggtctttatggaaatggagtagtgacaacaagtggaacctacgtcagtgccatagctcaagctaaagcatcacaagaagggcccctaccagagattgaggacgaggtgtttaggaaaagaaacttaacaataatggacctacatccaggatcgggaaaaacaagaagatatcttccagccatagtccgtgaggccataaaaaggaagctgcgcacactaattttggctcccacaagagtcgtcgcttccgaaatggcagaggcgctcaagggaatgccgataaggtatcagacaacagcagtgaagagtgaacacacaggaaaggagatagttgacctcatgtgccacgccactttcaccatgcgtctcctgtctcccgtgagagttcccaattacaacatgattatcatggatgaagcacatttcaccgatccatccagcatagcgggcagagggtacatatcaacccgagtgggcatgggtgaagcagctgcgatcttcatgacagccactcccccaggatcagtggaggcctttccacagagcaatgcagttatccaagatgaggaaagagacattcctgagagatcatggaactcaggctatgactggatcactgatttcccaggtaaaacagtctggtttgttccaagcatcaaatcaggaaatgacattgccaactgtttaagaaagaatgggaaacgggtgattcaattgagcaggaaaacctttgatacagagtaccaaaaaacaaaaaacaacgactgggactatgtcgtcacaacagacatttccgaaatgggagctaacttccgagccgacagggtaatagacccaagacggtgtctgaaaccggtaatactaaaagatggtccagagcgtgtcattctagcaggaccgatgccagtgactgtggccagtgccgcccagaggagagggagaatcggaaggaaccaaaataaggaaggtgatcagtacatctacatgggacagcctttaaacaacgatgaagatcacgctcattggacagaagcaaaaatgctccttgataatatgaacacaccagaagggattatcccagccctctttgaaccggagagagaaaagagtgcggcaatagacggggaatatagactacggggtgaagcaaggaaaacgttcgtggagctcatgagaagaggggatctacctgtctggctatcctataaagttgcctcagaagggttccagtactctgacagaatatggtgcttagatggggaaaggaacaatcaggtgttggaggagaacatggacgtggagatctggacaaaagaaggagaaagaaagaaactacgaccccgctggctggatgccagaacatactcagacccattggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctacagacatgcaatggaagaactcccagacaccatagaaacgttgatgctcctagctttgatagctgtgttaactggtggagtgacgctgttcttcctatcaggaaggggcttagggaaaacatctatcggcctactctgcgtgatggcttcaagcgtactgttatggatggccagtgtggagccccattggatagcggcctccatcatactggagttcttcctgatggtgctgcttattccagagccagacagacaacgcactccacaggacaaccagttggcatatgtagtgataggtttgttattcatgatactgacagtagcagccaatgagatgggattactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaatatttccctgacagctattgcaaaccaggcagctatattgatgggactcgacaaaggatggccaatatcgaagatggacataggagttccacttctcgccttggggtgctattcccaggtgaatccactgacgctgacagcggcagtattgatgctagtggctcattacgccataattggacctggactgcaagcaaaagctaccagagaagctcaaaaaaggacagcggccggaataatgaagaatccaactgtcgatggaatagttgcaatagatttggaccctgtggtttatgatgcaaaatttgagaaacaactaggccaaataatgttgttgatactatgcacatcacagatcctcttgatgcggactacatgggccttgtgtgaatccatcacactggctactggacctctgaccacgctttgggagggatctccaggaaaattttggaacaccacgatagccgtgtccatggcaaacatattcaggggaagttatctagcaggagcaggcctggccttctcactaatgaaatctctaggaggaggtaggagaggtacgggagcccaaggggaaacactgggagaaaaatggaaaagacagctgaaccaactgagcaagtcagaattcaacacttacaaaaggagtgggattatggaagtggatagatccgaagccaaagagggactgaaaagaggagaaacaaccaaacatgcagtgtcgagaggaaccgccaaactgaggtggtttgtggagaggaaccttgtgaaaccagaagggaaagtcatagacctcggttgtggaagaggtggctggtcatattattgcgctgggctgaagaaagtcacagaagtgaagggatacacaaaaggaggagctggacatgaggaaccaatcccaatggcgacctatggatggaacctagtaaaactatactccgggaaagacgtattctttacaccacctgaaaaatgtgacacccttttgtgtgacattggtgagtcctctccgaacccaaccatagaagaaggaagaacgttacgtgtcctaaagatggtggaaccatggctccggggaaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatagattcacaatggctcacaggaaaccaacatatgaaagagacgtggacttaggcgctggaacaagacatgtggcagtggaaccagaggtagccaacctagatatcattggccagaggatagagaacataaaacatgaacataagtcaacatggcattatgatgaggacaatccatacaagacatgggcctatcatggatcatatgaggtcaagccatcaggatcagcctcatccatggttaatggcgtggtgagactgctcaccaaaccatgggatgtcatccccatggtcacacaaatagccatgactgacaccacaccctttggacaacagagggtgtttaaagagaaagttgacacgcgcacaccaaaagcaaaacaaggcacagcacaaatcatggaggtgacagccaggtggttatggggttttctttctagaaacaaaaaaccaagaatctgcacaagagaggagttcacaagaaaagttaggtcaaacgcagctattggagcagtgttcgttgatgaaaatcaatggaactctgcaaaagaagcagtggaagatgagcggttttgggaccttgtgcacagagagagggagcttcacaaacagggaaagtgtgccacgtgtgtttacaatatgatggggaagagagagaaaaaactaggagagttcggaaaggcaaaaggaagtcgtgcaatatggtacatgtggttgggagcacgctttctagagtttgaagcccttggtttcatgaacgaagatcactggttcagtagagaaaattcactcagtggagtggaaggagaaggactccacaaactcggatatatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatctttaagctgacctaccaaaataaggtggtgagggtgcagagaccagcaaaaaatggaaccgtgatggatgttatatccagacgtgaccagagaggaagtggccaggtcggaacttatggcttgaacactttcaccaacatggaggcccagctaataagacaaatggagtctgagggaatcttttcacccagcgaattggagaccccaaatttggccgagagagttctcgactggttggaaaaatatggcgtcgaaaggctgaaaagaatggcaatcagcggagatgactgcgtggtgaaaccaattgatgacaggttcgcaacagccttaacagctctgaacgatatgggaaaagtaagaaaagacataccacaatgggaaccttcaaaaggatggaatgattggcaacaagtgcctttttgttcacaccatttccaccagctgattatgaaggatgggagggaaatagtggtgccatgccgcaaccaagatgaacttgtgggtagggctagagtatcacaaggtgccggatggagcctgagagaaactgcatgcctgggcaagtcatatgcacaaatgtggcagctgatgtacttccacaggagagacctgagactagctgctaatgccatctgttccgccgttccagtcgattgggtcccaaccagccgcaccacttggtcgatccatgcccatcatcaatggatgacaacagaaaacatgttgtcagtgtggaatagggtttggatagaggaaaacccatggatggaggacaaaacccatgtatccagttgggaagatgttccatatttagggaaaagggaagatcagtggtgtggatccctgataggcttaacagcaagggccacctgggccactaacatacaagtggctataaaccaagtgagaaggctaattgggaatgagaattatctagattacatgacatcaatgaagagattcaagaacgagagcgatcccgaaggggcactctggtga

SEQ ID NO: 33 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgctgcccacagccttggcgttccatctgactacacgagggggagagccgcacatgatagttagcaagcaggaaagaggaaagtcacttttgtttaagacctcagcaggtgtcaacatgtgcacccttatagcgatggatttgggagagttatgtgaggacacaatgacttacaaatgccctcgaattactgaggcggaaccagatgatgttgattgttggtgcaatgctacagacacatgggtgacctatggaacatgttcccaaactggcgagcaccgacgggacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccaaaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgattcaagatgtccaacacaaggagaagccacactggtggaagaacaagacgcgaactttgtgtgtcgacgaacgtttgtggacagaggctggggcaatggctgtgggctcttcggaaaaggcagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcctacgtcggaaatacagctgaccgactacggagctcttacattggattgctcacctagaacaggactggactttaatgaaatggtgttgttgacaatgaaagaaaaatcatggctagtccacaaacaatggtttctagacctaccactgccttggacctcgggagcttcaacatcacaagagacttggaacagacaagatttgctggtaacatttaagacagcccatgcaaagaagcaggaagtagtcgtactaggatcacaagaaggagcaatgcacactgcgttgaccggagcgacagaaatccaaacgtctggaacgacaacaattttcgcaggacacctgaaatgtagactaaaaatggacaaactgactttaaaagggatgtcatatgttatgtgcacaggctcattcaagctagagaaagaagtggctgagacccagcatggaaccgttctagtgcagattaaatacgaaggaacagatgcaccatgcaagatccctttttcgacccaagatgaaagaggagtaacccagaacgggagattaataacagccaaccctatagttactgacaaagaaaaaccagtcaacattgaggcagaaccgccttttggtgagagttacatcgtgataggagcaggtgaaaaagctttgaaactaagttggttcaagaaaggaagcagcatagggaaaatgtttgaggcaactgccagaggagcacgaaggatggccatactgggagacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcggaaaggcatgggaggagggtgtgtgtggaattcgatcagccactcgtctcgagaacatcatgtggaagcaaatatcaaatgaactgaaccacatcttacttgaaaatgacatgaaattcacagtggttgtaggagatgttgttgggatcttggcccaagggaaaaaaatgattaggccacaacccatggaacacaaatactcatggaaaagctggggaaaagctaaaatcataggggcagatgtacagaacaccaccttcatcatcgacggcccaaacactccagaatgccctgatgatcaaagagcatggaacatctgggaagttgaggactatggatttggaattttcacgacaaacatatggttgaaattgcgtgactcctacacccaagtgtgtgaccaccggctaatgtcagctgccatcaaggacagcaaggcagttcatgctgacatggggtactggatagaaagtgaaaagaacgagacctggaagctcgcaagagcctctttcatagaagttaaaacatgtgtctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgtttcaaaggagaagatggatgttggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagcagaaaaatgctgatgactggaacactggctgtgttcctccttctcataatgggacaattgacatggaatgatctgatcaggttatgcatcatggttggagccaatgcttcagacaggatggggatgggaacaacgtacctagctctgatggccacttttaaaatgagaccaatgtttgctgtcgggctgttgttccgcagactaacatctagagaagttcttcttcttacaattggattgagtctagtggcatctgtggagttaccaaattccctggaggagctgggggatggacttgcaatgggcattatgattttaaaattattgactgactttcagtcacatcagttgtgggctaccttgctgtccttgacatttgtcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaagaaaaagttggccccttaatgaaggaatcatggctgttggaatagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcgtcacacaatatattagtggaggtccaagatgatggaaccatgaagataaaagatgaagagagagatgacacgctaaccattctccttaaagcaaccctgctagcagtttcaggggtgtacccattatcaataccagcaaccctttttgtgtggtacttttggcagaaaaagaaacaaagatctggagtgttatgggacacacctagccctccagaagtggaaagagcagtccttgatgatggtatctacagaatcatgcagagaggactattgggcaggtcccaagtaggggtaggagttttccaagaaaacgtgttccacacaatgtggcatgttaccaggggagctgtactcatgtaccaagggaagagactagaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacagacagcgccgggtaccttcaagacccctgaaggtgaagttggagctattgccctagattttaaacccggcacatctggatctcccatcgtgaacagagaaggaaaaatagtaggtctttatggaaatggagtagtgacaacaagtggaacctacgtcagtgccatagcccaagccaaagcatcacaagaagggcccctaccagagattgaggacgaggtgtttaggaaaagaaacttaacaataatggacctacatccaggatcggggaaaacaagaagatatcttccagccatagtccgtgaggccataaaaaggaagctgcgtacactaattttggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttaccgatccatctagcatagcggccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggctatgagtggatcactgacttcccaggtaaaacagtctggtttgttccaagcatcaaatcaggaaatgacattgccaactgcttaagaaagaatgggaaacgggtgattcaattgagcaggaaaacctttgatacagagtaccaaaaaacaaaaaacaacgactgggattatgtcgtcacaacagatatctccgaaatgggagcaaacttccgagccgacagggtgatagacccaagacggtgtctgaaaccggtaatactaaaagatggtccagaacgtgtcattttagcaggaccgatgccagtgactgtagccagtgccgcccagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagccctcttcgagccggagagagaaaagagtgcagcaatagacggggaatatagactgcggggtgaagcaaggaaaacttttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaacgaaagaaactacgaccccgctggctggatgccagaacatactcagacccactggccctgcgcgagtttaaagagtttgcagcaggaagaagaagtgtctcaggtgatctaatattagaaatagggaaacttccacaacacttgacgcaaagggcccagaatgccttggacaacctggttatgttgcacaactccgaacaaggaggaagagcctacagacatgcaatggaagaacttccagacaccatagaaacgttgatgctcctagctttgatagctgtgttaactggtggagtgacgctgttcttcctatcaggaaagggcctagggaaaacatctatcggcctactctgcgtgatggcttcaagcgcactgctatggatggccagtgtggagcctcattggatagcagcctccatcatactggagtttttcctgatggtgctgcttattccagagccagacagacaacgcactccgcaggacaaccagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctttatgcagtggccacaacaattatcactcccatgatgaggcacacaatcgaaaacacaacggcaaacatttccctgacagctattgcaaaccaggcagctatattgatgggacttgataaaggatggccaatatcgaagatggacataggagttccacttctcgccctggggtgctattcccaggtgaatccactgacgctgacagcggcggtattgatgctagtggctcattacgccataattggacctggactgcaagcaaaagcgactatagaagctcaaaaaaggacagcggccggaataatgaaaaacccaaccgttgatggaattgttgccatagatttggaccctgtggtttatgatgcaaaatttgagaaacaactaggccaaataatgttgttgatactatgcacatcacagatcctcttgatgcggactacatgggccttgtgtgaatccatcacactggccactggacctctgaccacgctttgggagggatctccaggaaaattttggaacaccacgatagcggtttccatggcaaacattttcaggggaagttatctagcaggagcaggcctggctttctcattaatgaaatctctaggaggaggtaggagaggtacgggagcccaaggggaaacactgggagagaaatggaaaagacagctgaaccaactgagcaagtcagaattcaacacttacaaaaggagtgggattatggaagtggacagatccgaagccaaggagggactgaaaagaggagaaacaaccaaacatgcagtgtcgagaggaaccgccaaattgaggtggttcgtggagaggaaccttgtgaaaccagaagggaaagtcatagacctcggctgtggaagaggtggctggtcatactattgcgctgggctgaagaaagtcacagaagtgaagggatacacaaaaggaggacctggacatgaggaaccaatcccaatggcgacctatggatggaacctagtaaagctatactccgggaaagacgtattctttacaccacctgagaaatgtgacacccttttgtgtgatattggtgagtcctctccaaacccaactatagaagaaggaagaacgttacgcgtcctaaagatggtggaaccatggctcagagggaaccaattttgcataaaaattctaaatccctacatgccaagtgtggtggaaactctggagcaaatgcaaagaaaacatggaggaatgctagtgcggaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacttaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggacgtcatccccatggtcacacaaatagccatgactgacaccacaccctttggacaacagagggtgtttaaagagaaagttgacacgcgcacaccaaaagcaaaacgaggcacagcacaaatcatggaggtgacagccaggtggttatggggttttctctctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagtagagagaattcactcagtggagtggaaggagaaggactccacaaactcggatatatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtaagggtacagagaccagcgaaaaatggaaccgtgatggatgtcatatccagacgtgaccagagaggaagtggccaggtcggaacttatggcttaaacactttcaccaacatggaagcccagctaataagacagatggagtctgagggaatcttttcacccagcgaattggagaccccaaatttagccgagagagttctcgactggctggaaaaatatggcgtcgaaaggctgaaaagaatggcaatcagcggagatgactgcgtggtgaaaccaattgatgacaggttcgcaacagccttaacagctctgaatgatatgggaaaagtaagaaaagatataccacaatgggaaccctcaaaaggatggaatgattggcaacaggtgcctttttgttcacaccatttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagctgctaatgctatctgttcagccgttccagttgattgggtcccaaccagccgcaccacttggtcgatccatgcccatcaccaatggatgacaacagaagacatgttgtcagtgtggaatagggtttggatagaggaaaacccatggatggaggacaaaacccatgtatccagttgggaagatgttccatatttaggaaaaagggaagatcagtggtgtggatccctgataggcttaacagcaagggctacctgggccaccaacatacaagtggccataaaccaagtgagaagactaatcgggaatgagaattatctagattacatgacatcaatgaagagattcaagaacgagagtgatcccgaaggggcactctggtga

SEQ ID NO: 34 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgattaaagtgttacggggtttcaagaaagaaatctcaaacatgttgaatataatgaatagaaggaagagatccgtgaccatgctccttatgctgctgcccacagccttggcgtttcatctgaccacacgagggggagagccgcatatgatagttaccaagcaggaaagaggaaagtcacttttgtttaagacctcaactggtgtcaacatgtgcacccttattgcgatggatttgggagagttatgtgaggacacaatgacttacaaatgccctcgaatcactgaggcggaaccagatgacgttgattgttggtgcaatgccacagacacatgggtgacctatggaacgtgttcccaaactggcgagcaccgacgagacaaacgttccgtcgcactggccccacacgtgggacttggtctagaaacaagaaccgaaacgtggatgtcctctgaaggcgcttggaaacaaatacaaagagtggagacttgggccctgagacacccaggattcacagtgatagccctttttctagcacatgccataggaacatccatcacccagaaagggattattttcattttgttgatgctggtaacaccatccatggccatgcgatgtgtgggaataggcaacagggacttcgtggaaggactgtcaggagcaacgtgggtagatgtggtactggaacatggaagttgcgtcaccaccatggcaaaagataaaccaacattggacattgaactcttgaagacggaagtcacaaaccctgccgttctgcgcaaactgtgcatcgaagctaaaatatcaaacaccaccaccgattcaagatgtccaacacaaggagaagccacactggtggaagaacaagacgcgaattttgtgtgtcgacgaacgtttgtggacagaggctggggcaatggctgtgggcttttcggaaaaggtagcctaataacgtgtgctaagttcaagtgtgtgacaaaactggaaggaaagatagttcaatatgaaaacttgaaatattcagtaatagtcaccgtccacagtggagaccagcaccaggtgggaaatgaaagcacagaacatgggacaacagcaactataacacctcaagctcccacgtcggaaatacagctgaccgactacggagctcttacattggattgctcacctagaacaggactagacttcaatgaaatggtgttgttgacaatgaaagaaaaatcatggctagtccacaaacaatggtttctagacctaccactgccttggacctcgggagcttcaacgtcacaagagacttggaacagacaagatttgctggtaacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaaaatggacaaactgactctaaaagggatgtcatatgtgatgtgcacaggctcattcaagctagagaaagaggtggctgagacccagcatggaaccgttctagtgcaggttaaatacgaaggaacagatgcaccatgcaagatccctttttcgacccaagatgagaaaggagtaacccagaatgggagagtgataacagccaaccctatagtcactgacaaggaaaaaccagtcaacattgaggcagaaccaccttttggtgagagttacatcgtggtaggagcaggtgaaaaagctctgaaactaagctggttcaagaaaggaagcagcatagggaaaatgtttgaggcaactgcccgaggagcacgaaggatggccatactgggagacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagtacgtccctttcgatgacgtgcattgcagttggcctggtaacactgtacctaggagtcatggttcaggcggattcgggatgtgtaattaattggaaaggcagagaactcaaatgtggaagtggcatctttgtcaccaatgaagttcacacttggacagagcaatacaaatttcaggctgactccccaaagagactatcagcagctatcgggaaggcatgggaggagggtgtgtgtggaattcgatcagccactcgtctcgagaacatcatgtggaagcaaatatcaaatgaactgaaccacatcttacttgaaaatgacatgaaattcacagtggttgtaggagatgttagtgggatcttggcccaaggaaaaaaaatgattaggccacaacccatggaacacaaatactcgtggaaaagctggggaaaagctaaaatcataggggcagatgtacagaactccaccttcatcatcgacggcccaaacaccccagaatgccccgatgatcaaagagcatggaacatttgggaagttgaggactatggatttggaattttcacgacaaacatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcgagagcctccttcatagaagttaaaacatgcgtctggccaaaatcccacactctatggagcaatggagttctggaaagtgaaatgataattccaaagatatatggaggaccaatatctcagcacaactacagaccaggatatttcacacaaacagcagggccgtggcacttaggcaagttggaactagattttgatttgtgtgagggtaccacagttattgtggatgaacattgtggaaatcgaggaccatctcttagaaccacaacagtcacaggaaaaataatccatgaatggtgctgcagatcttgtacgctaccacccttacgtttcaaaggagaagatgggtgttggtacggtatggaaattagaccagtcaaggaaaaggaagagaatctagtcaaatcaatggtctctgcagggtcaggagaagtggacagcttttcactaggactgctatgcatatcaataatgatcgaagaggtgatgagatctagatggagtagaaaaatgctgatgactggaacactggctgtgttcctccttctcataatgggacaattgacatggaatgatctgatcaggttatgcatcatggttggagccaatgcttcagacaggatggggatgggaacaacgtacctagctctgatggccacttttaaaatgagaccaatgtttgctgtcgggctattattccgcagactaacatctagagaagttcttcttcttacaattggattgagtctagtggcatccgtggagctaccaaattccttggaggagctgggggatggacttgcaatgggcattatgatcttaaaattactgactgactttcagtcatatcagctgtgggctgccttgctgtccctgacatttatcaaaacaacttattctttgcactatgcatggaagacaatggctatggtactgtcaattgtgtctctcttccccttatgcctgtccacgacctctcaaaagacaacatggcttccggtgctattgggatctcttggatgcaaaccactaaccatgtttcttatagcagaaaacaaaatctggggaaggaaaagttggcctctcaatgaaggaattatggctgttggaatagtcagcatcttactaagttcactcctcaaaaatgatgtgccgctagctgggccactaatagctggaggcatgctaatagcatgttatgttatatctggaagctcagccgatttatcactagagaaagcggctgaggtctcctgggaagaagaagcagaacactctggtgcctcacacaatatattagtggaggtccaagatgatggaaccatgaagataaaagatgaagagagagatgacacactaaccattctccttaaagcaactctgctggcagtttcaggggtgtacccattatcaataccagcgaccctttttgtgtggtatttttggcagaaaaagaaacagagatcaggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagttgggctagtgtcaaaaaagacctgatctcatatggaggaggttggaggcttcaaggatcctggaatacgggagaagaagtgcaggtgattgctgttgaaccagggaaaaaccccaaaaatgtacagacagcgccgggcaccttcaagacccctgaaggtgaagttggagccatagccctagattttaaacccggcacatctggatctcccattgtgaacagagaggggaaaatagtaggtctttatggaaatggagtagtgacaacaagtggaacctacgtcagtgccatagctcaagctaaagcatcacaagaagggcccttaccagagattgaggatgaggtgtttaggaaaagaaacttaacaataatggacctacatccaggatcgggaaaaacaagaagatatcttccagccatagtccgtgaggccataaaaaggaagctgcgcacactaattttggctcccacaagagttgtcgcttccgaaatggcagaggcgctcaagggaatgccgataaggtatcagacaacagcagtgaagagtgaacacacaggaaaggagatagttgacctcatgtgccacgccactttcaccatgcgtctcctgtctcccgtgagagttcccaattacaacatgattatcatggatgaagcacatttcaccgatccatccagcatagcggccagagggtacatatcaacccgagtgggcatgggtgaagcagctgcgatcttcatgacagccactcccccaggatcagtggaggcctttccacagagcaatgcagttatccaagatgaggaaagagacattcctgagagatcatggaactcaggctatgactggatcactgatttcccaggtaaaacagtctggtttgttccaagcatcaaatcaggaaatgacattgccaactgtttaagaaagaatgggaaacgggtgattcaattgagcaggaaaacctttgatacagagtaccaaaaaacaaaaaacaacgactgggactatgtcgtcacaacagacatttccgaaatgggagctaacttccgagccgacagggtaatagacccaagacggtgtctgaaaccggtaatactaaaagatggtccagagcgtgtcattctagcaggaccgatgccagtgactgtggccagtgccgcccagaggagagggagaatcggaaggaaccaaaataaggaaggtgatcagtacatctacatgggacagcccttaaacaacgatgaagatcacgctcattggacagaagcaaaaatgctccttgataatataaacacaccagaagggattatcccagccctctttgaaccggagagagaaaagagtgcggcaatagacggggaatatagactgcggggtgaagcaaggaaaacgtttgtggatctcctgagaagaggggatctacctgtctggctatcctacaaagttgcctcagaaggcttccagtactctgacagaagatggtgctttgatggggaaaggaacaatcaggtgttggaggagaacatggacgtggagatctggacaaaagaaggagaaagaaagaaactacgaccccgctggctggatgccagaacttactcagacccattggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctacagacatgcaatggaagaactcccagacaccatagaaacgttgatgctcctagctttgatagctgtgttaactggtggagtgacgctgttcttcctatcaggaaggggcttagggaaaacatctatcggcctactctgcgtgatggcttcaagcgtactgttatggatggccagtgtggagccccattggatagcggcctccatcatactggagttcttcctgatggtgctgcttattccagagccagacagacaacgcactccacaggacaaccagttggcatatgtagtgataggtttgttattcatgatactgacagtagcagctaatgagatgggattactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaatatttccctgacagctattgcaaaccaggcagctatattgatgggactcgacaaaggatggccaatatcgaagatggacataggagttccacttctcgccttggggtgctattcccaggtgaatccactgacgctgacagcggcagtatcgatgctagtggctcattacgccataattggacctggactgcaagcaaaagctactagagaagctcaaaaaaggacagcggccggaataatgaagaatccaactgtcgatggaatagttgcaatagatttggaccctgtggtttatgatgcaaaatttgagaaacaactaggccaaataatgttgttgatactatgcacatcacagatcctcttgatgcggactacatgggccttgtgtgaatccatcacactggctactggacctctgaccacgctttgggagggatctccaggaaaattttggaacaccacgatagccgtgtccatggcaaacatattcaggggaagttatctagcaggagcaggcctggccttctcactaatgaaatctctaggaggaggtaggagaggtacgggagcccaaggggaaacactgggagaaaaatggaaaagacagctgaaccaactgagcaagtcagaattcaacacttacaaaaggagtgggattatggaagtggatagatccgaagccaaagagggactgaaaagaggagaaacaaccaaacatgcagtgtcgagaggaaccgccaaactgaggtggtttgtggagaggaaccttgtgaaaccagaagggaaagtcatagacctcggttgtggaagaggtggctggtcatattattgcgctgggctgaagaaagtcacagaagtgaagggatacacaaaaggaggagctggacatgaggaaccaatcccaatggcgacctatggatggaacctagtaaagctatactccgggaaagacgtattctttacaccacctgagaaatgtgacacccttttgtgtgacattggtgagtcctctccgaacccaaccatagaagaaggaagaacgttacgtgtcctaaagatggtggaaccatggctccgaggaaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatagattcacaatggctcacaggaaaccaacatatgaaagagacgtggacttaggcgctggaacaagacatgtggcagtggaaccagaggtagccaacctagatatcattggccagaggatagagaacataaaacatgaacataagtcaacatggcattatgatgaggacaatccatacaagacatgggcctatcatggatcatatgaggtcaagccatcaggatcagcctcatccatggttaatggcgtggtgagactgctcaccaaaccatgggatgtcatccccatggtcacacaaatagccatgactgacaccacaccctttggacaacagagggtgtttaaagagaaagttgacacgcgcacaccaaaagcaaaacaaggcacagcacaaatcatggaggtgacagccaagtggttatggggttttctttctagaaacaaaaaaccaagaatctgtacaagagaggagttcacaagaaaagttaggtcaaacgcagctattggagcagtgttcgttgatgaaaatcaatggaactctgcaaaagaagcagtggaagatgagcggttttgggaccttgtgcacagagagagggagcttcacaaacagggaaaatgtgccacgtgtgtttacaatatgatggggaagagagagaaaaaactaggagagttcggaaaggcaaaaggaagtcgtgcaatatggtacatgtggttgggagcacgctttctagagtttgaagcccttggtttcatgaacgaagatcactggttcagtagagagaattcactcagtggagtggaaggagaaggactccacaaactcggatatatactcagagacatatcaaagattccagggggaaatatgtatgcagatgacacagccggatgggatacaaggataacagaggatgatcttcagaatgaggccaaaattactgacatcatggagcccgaacatgccttactggctacgtcaatctttaagctgacctaccaaaataaggtggtgagggtgcagagaccagcaaaaaatggaaccgtgatggatgttatatccagacgtgaccagagaggaagtggccaggtcggaacttatggcttaaacactttcaccaacatggaggcccagctaataagacaaatggagtctgagggaatcttttcacccagcgaattggagaccccaaatttggccgagagagttctcgactggttggaaaaatatggcgtcgaaaggctgaaaagaatggcaatcagcggagatgactgcgtggtgaaaccaattgatgacaggttcgcaacagccttaacagctctgaacgatatgggaaaagtaagaaaagacataccacaatgggaaccttcaaaaggatggaatgattggcaacaagtgcctttttgttcacaccatttccaccagctgattatgaaggatgggagggaaatagtggtgccatgccgcaaccaagatgaacttgtgggtagggctagagtatcacaaggtgccggatggagcctgagagaaactgcatgcctgggcaagtcatatgcacaaatgtggcagctgatgtacttccacaggagagacctgagactagctgctaatgccatctgttccgccgttccagtcgattgggtcccaaccagccgcaccacttggtcgatccatgcccatcatcaatggatgacaacagaaaacatgttgtcagtgtggaatagggtttggatagaggaaaacccatggatggaggacaaaacccatgtatccagttgggaagatgttccatatttagggaaaagggaagatcagtggtgtggatccctgataggcttaacagcaagggccacctgggccactaacatacaagtggccataaaccaagtgagaaggctaattgggaatgagaattatctagattacatgacatcaatgaagagattcaagaacgagagcgatcccgaaggggcactctggtga

SEQ ID NO: 35 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagagagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaatcagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagttggcccctcaatgaagggatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtaacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcgatcttcatgacagccactcccccaggatcaatggaggcctttccacagagcaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaagggcctagggaaaacatctatcggcctactctgcgtgatggcttcaagcgtactgctatggatggccagtgtggagccccattggatagcggcctccatcatactggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggggcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgtcccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 36 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacctatgaaactggtgatggctttcatagcattcctaagatttctagccatacccccaacagcaggaattttggctagatggggctcattcaagaagaatggagcgatcaaagtgctacggggtttcaagaaagaaatctcaagcatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcatgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaaccataacacctcaagctcctacgacagaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgtcatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcactaggggagctgtactcatgtatcaagggaagagactggaaccgagctgggccagtgtcaagaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctgcatccaggatcgggaaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggttatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctatatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggaactcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattggaaataggaaaacttccacaacacttgacgcaaagggcccagaatgccttggacaacctggttatgctgcacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaaaatggacataggagttccacttctcgccttggggtgctattcccaggtgaatccactgacgctgacagcggcggtattgatgctagtggcccattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcagtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcataggagaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagtcaggtggttatggggttttctttctagaaacaagaagccaagaatttgtacaagagaggagttcacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaaccgcatgcctaggcaaatcatatgcacaaatgtggcagctgatgtacttccacaggagagacctgagactagctgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 37 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggagctcattcaagaagaatggagcgatcaaagtgctacggggtttcaagaaagaaatctcaaacatgttgaatgtaatgaatagaaggaaaagatctgtgaccatgctccttatgctgctgcccacagccttggcgttccatctgactacacgagggggagagccgcacatgatagttagcaagcaggaaagaggaaagtcacttttgtttaagacctcagcaggtgtcaacatgtgcacccttatagcgatggatttgggagagttatgtgaggacacaatgacttacaaatgccctcgaattactgaggcggaaccagatgatgttgattgttggtgcaatgctacagacacatgggtgacctatggaacatgttcccaaactggcgagcaccgacgggacaaacgttccgtcgcactggccccacacgtgggacttggtttggaaacaagaaccgaaacgtggatgtcctctgaaggcgcttggaaacagatacaaagagtggagacttgggctctgagacacccaggattcacggtgatagccctttttctagcacatgccataggaacatccatcacccaaaaaggggttattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgattcaagatgtccaacacaaggagaagccacactggtggaagaacaagacgcgaactttgtgtgtcgacgaacgtttgtggacagaggctggggcaatggctgtgggctcttcggaaaaggcagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcctacgtcggaaatacagctgaccgactacggagctctcacattggattgctcacctagaacaggactggactttaatgaaatggtgttgttgacaatgaaagaaaaatcatggctagtccacaaacaatggtttctagacctaccactgccttggacctcgggagcttcaacatcacaagagacttggaacagacaagatttgctggtaacatttaagacagcccatgcaaagaagcaggaagtagtcgtactaggatcacaagaaggagcaatgcacactgcgttgaccggagcgacagaaatccaaacgtctggaacgacaacaattttcgcaggacacctgaaatgtagactaaaaatggacaaactgactttaaaagggatgtcatatgttatgtgcacaggctcattcaagctagagaaagaagtggctgagacccagcatggaaccgttctagtgcagattaaatacgaaggaacagatgcaccatgcaagatccctttttcgacccaagatgaaagaggagtaacccagaacgggagattaataacagccaaccctatagttactgacaaagaaaaaccagtcaacattgaggcagaaccgccttttggtgagagttacatcgtgataggagcaggtgaaaaagctttgaaactaagttggttcaagaaaggaagcagcatagggaaaatgtttgaggcaactgccagaggagcacgaaggatggccatactgggagacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcggaaaggcatgggaggagggtgtgtgtggaattcgatcagccactcgtctcgagaacatcatgtggaagcaaatatcaaatgaactgaaccacatcttacttgaaaatgacatgaaattcacagtggttgtaggagatgttgttgggatcttggcccaagggaaaaaaatgattaggccacaacccatggaacacaaatactcatggaaaagctggggaaaagctaaaatcataggggcagatgtacagaacaccaccttcatcatcgacggcccaaacactccagaatgccctgatgatcaaagagcatggaacatctgggaagttgaggactatggatttggaattttcacgacaaacatatggttgaaattgcgtgactcctacacccaagtgtgtgaccaccggctaatgtcagctgccatcaaggacagcaaggcagttcatgctgacatggggtactggatagaaagtgaaaagaacgagacctggaagctcgcaagagcctctttcatagaagttaaaacatgtgtctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgtttcaaaggagaagatggatgttggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagcagaaaaatgctgatgactggaacactggctgtgttcctccttctcataatgggacaattgacatggaatgatctgatcaggttatgcatcatggttggagccaatgcttcagacaggatggggatgggaacaacgtacctagctctgatggccacttttaaaatgagaccaatgtttgctgtcgggctgttgttccgcagactaacatctagagaagttcttcttcttacaattggattgagtctagtggcatctgtggagttaccaaattccctggaggagctgggggatggacttgcaatgggcattatgattttaaaattattgactgactttcagtcacatcagttgtgggctaccttgctgtccttgacatttgtcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaagaaaaagttggccccttaatgaaggaatcatggctgttggaatagtcagcatcctactaagttcactcctcaaaaatgatgtgccgctggctgggccactaatagctggaggcatgctaatagcatgttatgttatatctggaagctcagccgacttatcactagagaaaacggctgaggtctcctgggaagaagaagcagaacactctggtgcgtcacacaatatattagtggaggtccaagatgatggaaccatgaagataaaagatgaagagagagatgacacgctaactattctccttaaagcaaccctgctagcagtttcaggggtgtacccattatcaataccagcaaccctttttgtgtggtacttttggcagaaaaagaaacaaagatctggagtgttatgggacacacctagccctccagaagtggaaagagcagtccttgatgatggtatctacagaatcatgcagagaggactattgggcaggtcccaagtaggggtaggagttttccaagaaaacgtgttccacacaatgtggcatgttaccaggggagctgtactcatgtaccaagggaagagactagaaccgagttgggccagtgtcaaaaaagacctgatctcatatggaggaggttggaggcttcaaggatcctggaacacgggagaagaagtgcaggtgattgctgttgaaccaggaaaaaacccaaaaaatgtacagacagcgccgggtaccttcaagacccctgaaggtgaagttggagctattgccctagattttaaacccggcacatctggatctcccatcgtgaacagagaaggaaaaatagtaggtctttatggaaatggagtagtgacaacaagtggaacctacgtcagtgccatagcccaagccaaagcatcacaagaagggcccctaccagagattgaggacgaggtgtttaggaaaagaaacttaacaataatggacctacatccaggatcggggaaaacaagaagatatcttccagccatagtccgtgaggccataaaaaggaagctgcgtacactaattttggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttaccgatccatctagcatagcggccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggctatgagtggatcactgacttcccaggtaaaacagtctggtttgttccaagcatcaaatcaggaaatgacattgccaactgcttaagaaagaatgggaaacgggtgattcaattgagcaggaaaacctttgatacagagtaccaaaaaacaaaaaataacgactgggattatgtcgtcacaacagatatctccgaaatgggagcaaacttccgagccgacagggtgatagacccaagacggtgtctgaaaccggtaatactaaaagatggtccagaacgtgtcattttagcaggaccgatgccagtgactgtagccagtgccgcccagaggagaggaagaattggaaggaaccacaataaggaaggtgatcagtacatctacatgggacagcctttaaacaatgatgaagatcacgctcactggacagaagcaaaaatgctccttgacaatataaacacaccagaagggattatcccagccctcttcgagccggagagagaaaagagtgcagcaatagacggggaatatagactgcggggtgaagcaaggaaaacttttgtggagctcatgagaagaggagatctacctgtctggctatcctacaaagttgcctcagaagggttccagtactctgacagaagatggtgctttgacggggaaaggaacaaccaggtgttggaggagaacatggacgtggagatctggacaaaagagggagaacgaaagaaactacgaccccgctggctggatgccagaacatactcagacccactggccctgcgcgagtttaaagagtttgcagcaggaagaagaagtgtctcaggtgatctaatattagaaatagggaaacttccacaacacttgacgcaaagggcccagaatgccttggacaacctggttatgttgcacaactccgaacaaggaggaagagcctacagacatgcaatggaagaacttccagacaccatagaaacgttgatgctcctagctttgatagctgtgttaactggtggagtgacgctgttcttcctatcaggaaagggcctagggaaaacatctatcggcctactctgcgtgatggcttcaagcgcactgctatggatggccagtgtggagcctcattggatagcagcctccatcatactggagtttttcctgatggtgctgcttattccagagccagacagacaacgcactccgcaggacaaccagctggcatatgtggtgataggtttgttattcatgatactgacagtagcagccaatgagatgggactactggaaaccacaaagaaagacctagggattggccatgtggctgttgaaaatcaccaccatgccacaatgctggacgtagacttacatccagcttcagcctggaccctttatgctgtggccacaacaattatcactcccatgatgaggcacacaatcgaaaacacaacggcaaacatttccctgacagctattgcaaaccaggcagctatattgatgggacttgataaaggatggccaatatcgaagatggacataggagttccacttctcgccctggggtgctattcccaggtgaatccactgacgctgacagcggcggtcttgatgctagtggctcattacgccataattggacctggactgcaagcaaaagcgactagagaagctcaaaaaaggacagcggccggaataatgaaaaacccaaccgttgatggaattgttgccatagatttggaccctgtggtttatgatgcaaaatttgagaaacaactaggccaaataatgttgttgatactatgcacatcacagatcctcttgatgcggactacatgggccttgtgtgaatccatcacactggccactggacctctgaccacgctttgggagggatctccaggaaaattttggaacaccacgatagcggtttccatggcaaacattttcaggggaagttatctagcaggagcaggcctggctttctcattaatgaaatctctaggaggaggtaggagaggtacgggagcccaaggggaaacactgggagagaaatggaaaagacagctgaaccaactgagcaagtcagaattcaacacttacaaaaggagtgggattatggaagtggacagatccgaagccaaggagggactgaaaagaggagaaacaaccaaacatgcagtgtcgagaggaaccgccaaattgaggtggttcgtggagaggaaccttgtgaaaccagaagggaaagtcatagacctcggctgtggaagaggtggctggtcatactattgcgctgggctgaagaaagtcacagaagtgaagggatacacaaaaggaggacctggacatgaggaaccaatcccaatggcgacctatggatggaacctagtaaagctatactccgggaaagacgtattctttacaccacctgagaaatgtgacacccttttgtgtgatattggtgagtcctctccaaacccaactatagaagaaggaagaacgttacgcgtcctaaagatggtggaaccatggctcagagggaaccaattttgcataaaaattctaaatccctacatgccaagtgtggtggaaactctggagcaaatgcaaagaaaacatggaggaatgctagtgcggaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacttaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggacgtcatccccatggtcacacaaatagccatgactgacaccacaccctttggacaacagagggtgtttaaagagaaagttgacacgcgcacaccaaaagcaaaacgaggcacagcacaaatcatggaggtgacagccaggtggttatggggttttctctctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagtagagagaattcactcagtggagtggaaggagaaggactccacaaactcggatatatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtaagggtacagagaccagcgaaaaatggaaccgtgatggatgtcatatccagacgtgaccagagaggaagtggccaggtcggaacttatggcttaaacactttcaccaacatggaagcccagctaataagacagatggagtctgagggaatcttttcacccagcgaattggagaccccaaatttagccgagagagttctcgactggctggaaaaatatggcgtcgaaaggctgaaaagaatggcaatcagcggagatgactgcgtggtgaaaccaattgatgacaggttcgcaacagccttaacagctctgaatgatatgggaaaagtaagaaaagatataccacaatgggaaccctcaaaaggatggaatgattggcaacaggtgcctttttgttcacaccatttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagctgctaatgctatctgttcagccgttccagttgattgggtcccaaccagccgcaccacttggtcgatccatgcccatcaccaatggatgacaacagaagacatgttgtcagtgtggaatagggtttggatagaggaaaacccatggatggaggacaaaacccatgtatccagttgggaagatgttccatatttaggaaaaagggaagatcagtggtgtggatccctgataggcttaacagcaagggctacctgggccaccaacatacaagtggccataaaccaagtgagaagactaatcgggaatgagaattatctagattacatgacatcaatgaagagattcaagaacgagagtgatcccgaaggggcactctggtga

SEQ ID NO: 38 - DNA, 10179 bp, Dengue virus
atgaacaaccaacggaagaagacgggtcgaccgtctttcaatatgctgaaacgcgcgagaaaccgcgtgtcaactggttcacagttggcgaagagattctcaaaaggattgctctcaggccaaggacccatgaaattggtgatggcttttatagcattcctaagatttctagccatacccccaacagcaggaattttggctagatggagctcattcaagaagaatggagcgatcaaagtgttacggggtttcaaaaaagagatctcaagcatgttgaacataatgaacaggagaaaaagatccgtgaccatgctccttatgctgctgcccacagccctggcgttccatttgaccacacgagggggagagccacacatgatggttagcaagcaggaaagaggaaagtcactcttgtttaagacctctgcaggtgtcaacatgtgcaccctcattgcaatggatttgggagagttatgtgaggacacaatgacctacaaatgcccccggatcactgaagcggaaccagatgatgttgattgctggtgcaatgccacagacacatgggtgacctatgggacgtgttctcaaactggcgaacaccgacgggataaacgttctgtcgcactggccccacacgtggggcttggtctagaaacaagaaccgaaacgtggatgtcctctgaaggcgcctggagacagatacaaaaagtggagacttgggccttgagacacccaggattcacggtgatagccctttttctagcacataccataggaacatccatcacccagaaagggattatcttcattttgctgatgctggtgacaccatcaatggccatgcgatgcgtgggaataggcaacagagacttcgttgaaggactgtcaggagcaacgtgggtggatgtggtactggagcatggaagctgcgtcaccaccatggcaaaaaataaaccaacattggacattgaactcttgaagacggaggtcacgaaccctgccgtcttgcgcaaactgtgtattgaagctaaaatatcaaacaccaccaccgattcaagatgcccaacacaaggagaagctacactggtggaagaacaagacgcgaactttgtgtgtcgacgaacattcgtggacagaggctggggtaatggctgtggactattcgggaaaggaagcttactgacgtgtgctaagtttaagtgtgtgacaaaacttgaaggaaagatagttcaatatgaaaacttaaaatattcggtgatagtcactgtccacactggggaccagcaccaggtgggaaatgagaccacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccactgccttggacctcgggggcttcaacatctcaagagacttggaacagacaagatttgctggtcacatttaagacagctcatgcaaagaagcaggaagtagtcgtactggggtcacaagaaggagcaatgcacactgcgttgactggggcgacagaaatccagatgtcaggaacgacgacaatcttcgcaggacacctgaaatgtagactaaaaatggataaactgactttaaaaggggtgtcatatgtgatgtgcacaggctcatttaagttagagaaggaagtggctgagacccagcatggaaccgtcctagtgcaggttaaatacgaaggaacagatgcaccatgcaagattcccttttcaacccaagatgagaaaggagtgacccagaatgggagattgataacagccaatcccatagttactgacaaagaaaaaccagtcaacattgagacagaaccaccttttggtgagagctacatcgtgataggggcgggtgaaaaagctttgaaactaagctggttcaagaaaggaagcagcatagggaaaatgttcgaagctaccgcccgaggagcacgaaggatggctatcctgggagacacagcatgggacttcggttccataggaggggtgttcacatctgtgggaaaattggtacaccaggtttttggaaccgcatatggggttttgttcagcggtgtttcttggaccatgaaaataggaataggaattctgctgacatggctaggattaaattcaaggagcacgtcactctcgatgacgtgcattgcagttggcatggtcacactgtacctaggagtcatggttcaagcggactcggggtgtgtgatcaactggaagggcagagaactcaaatgtggaagtggcatcttcgtcactaatgaagtccacacttggacagagcaatataaattccaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgctaatggaatcttgacccaaggaaaaaagatgattaggccacaacccatggaacacaaatactcatggaaaagctggggaaaagccaaaatcataggagcagacatacagaataccaccttcatcatcgatggcccagacactccagaatgccccgatgaccagagagcatggaacatttgggaagttgaggactatgggtttggaattttcacgacaaacatatggctgaaattgcgtgactcctacacccaaatgtgtgaccaccggctaatgtcagctgccatcaaggacagtaaggcagtccatgctgacatggggtactggatagaaagtgaaaagaacgagacctggaagctagcgagagcctccttcatagaagtgaagacatgcatctggccaagatcccacactctatggagcaatggagtcctggaaagtgaaatgataatcccaaagatatatggaggaccaatatctcagcacaactacagaccagggtacttcacacaaacagcagggccatggcacctaggcaagttggaactagactttgatttgtgtgaaggcaccacagttgttgtggatgaacattgtggaaatcgaggtccatctcttagaactacaacagtcacaggaaagataatccatgaatggtgttgcagatcctgcacgctaccccccttacgcttcaaaggagaagacggatgttggtatggcatggaaatcagaccagttaaggagaaggaggagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacaggatggggatgggaacaacgtatctagccttgatggccactttcaaaatgagaccgatgttcgctgttgggctattattccgcagactaacatccagagaggttctccttctcacaattggactaagcctggtggcatccgtggagctaccaaattctttagaggagctaggggacggacttgcaatgggcatcatgatgttaaaattattgactgattttcagtcacaccagttatggactaccttactgtctctgacatttataaaaacaactctttcattggattatgcatggaagacaatagctatggtactgtcaatcgtatctctctttcctttatgtctatctacgacctctcaaaaaacaacatggcttccggtgctgttaggatcttttggatgcaaaccactaaccatgtttctcataacagaaaacaaaatctggggaaggaaaagttggcccctcaatgaaggaattatggctgttggaatagtcagcattttactaagttcactcctcaaaaatgatgtgccactagccggcccactaatagctggaggcatgctaatagcatgttacgtcatatccggaagctcagccgatttatcattggagaaagcggctgaggtctcctgggaagaagaagcagaacactctggtgcctcacacaacatactagtggaggtccaagatgatggaactatgaaaataaaagatgaagagagagatgacacgctcactatactccttaaagcaactctgttggcagtctcaggggtgtacccaatgtcaataccagcaaccctttttgtgtggtatttttggcagaaaaagaaacagagatcaggagtcttgtgggacacacccagccctccagaagtggaaagagcagttcttgatgatggtatctatagaatcttgcaaagaggactgttgggtaggtcccaagtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgagccaggaaaaaacccaaaaaatgtacagacaacgccgggcaccttcaagacccctgaaggcgaagttggagccatagccctagattttaaacccggcacatctggatctcccatcgtgaacagagagggaaaaatagtaggtctttatggaaatggagtggtgacaacaagtggaacctacgtcagtgccattgcccaagctaaagcatcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaagggagatagttgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggtaaaacagtctggtttgttccaagcatcaaatcaggaaatgacattgccaactgtttaagaaagaacgggaaacgggtgatccaattgagcagaaaaacctttgacactgaataccagaaaacaaaaaacaatgactgggactatgttgtcacaacagacatttccgaaatgggagcaaatttccgggccgacagggtaatagacccaaggcggtgcttgaagccggtaatactaaaagatggcccagagcgcgtcattctagccggaccaatgccagtgaccgtggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaacacgccagaagggattatcccagccctctttgagccggagagagaaaagagtgcagcaatagacggggagtacagactgcggggagaagcaaggaaaacgttcgtggagctaatgagaagaggggatctaccagtttggctatcttacaaagttgcctcagaaggcttccagtactccgacagaaggtggtgctttgacggggaaaggaacaaccaggtgttggaggagaacatggacgtggagatctggacaaaagaaggagaaagaaagaaattacgacctcgctggttagatgccagaacctactctgatccactggccctgcgcgagtttaaagagttcgcagcaggaagaagaagtgtctcaggtgacctaatattagaaatagggaaacttccacagcatttggcgctaagggcccagaatgctttggacaacttggtcatgttgcacaattccgaacaaggaggaaaagcctatagacatgctatggaagaattaccagacaccatagaaacattgatgctcctagctttgatagctgtgctgactggtggagtgacgttgtttttcctatcaggaaaaggtctagggaaaacatccattggcctactttgtgtgatggcctcaagtgtactgttatggatggccagtgtggagccccattggatagcggcctccatcatactagagttctttctgatggtgctgctcattccagagccagacagacagcgtactccacaggacaatcagctagcatatgtggtgataggtttgttattcatgatattgacagtggcagccaatgagatgggattactggaaaccacaaagaaagacctggggattggccatgtagtcgccgaaaaccaccaccatgctacaatgctagacatagacttacatccagcttcagcctggaccctctatgcagtagccacaacaattatcactcccatgatgagacacacaattgaaaacacaacggcaaatatttccctgacagctattgcaaatcaggcggctatattgatgggacttgacaagggatggccaatatcgaagatggacataggagtgccacttctcgccttagggtgctattcccaggtgaacccattgacactgacagcggcggtgttgatgttagtggctcattatgccataatcggacctggactgcaagcaaaagctactagagaagcccaaaaaaggacagcggccggaataatgaaaaatccaactgtagacgggattgttgcaatagatttggatcctgtggtttacgatgcaaaatttgaaaaacagctaggccaaataatgttactgatactttgcacatcacagattctcttgatgcggactacatgggccttatgtgaatccatcacactggctactggacccttgaccactctctgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacattgggagaaaaatggaaaagacaactaaaccaactgagcaagtcagaattcaacacttacaaaaggagtggaattatggaggtggacagatctgaagccaaggagggactgaaaagaggagaaacaaccaaacatgcagtgtcgagaggaacagccaaacttaggtggtttgtggagaggaaccttgtgaaaccagaagggaaagtgatagacctcggttgtggaagaggtggctggtcatattattgcgctgggctgaagaaggttacagaagtgaagggatacacaaaaggaggacccggtcatgaggaacctatcccaatggcgacttatggatggaacctagtgaagctatactccggaaaagatgtattctttacaccacctgagaaatgtgacacccttttatgtgatattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgttgctgaatcggttcacaatggctcacaggaagccaacatatgaaagagacgtggacttgggcgctggaacaagacatgtggcagtggaaccagagatagccaacctagacatcattggccagaggatagagaacataaaaaatgaacataagtcaacatggcattatgatgaggacaatccatacaaaacatgggcctatcatggatcatatgaggtcaagccatcaggatcagcctcatccatggtgaatggcgtggtgagactgctcaccaaaccatgggatgttatccccatggtcacacaaatagctatgactgataccacacccttcggacaacagagggtgtttaaagagaaagttgacacacgcacaccaagaccaaaacgaggcacagcacaaattatggaggtgacagccaagtggttgtggggtttcctctctagaaataaaaaacccagaatctgcacaagagaggagttcacaagaaaagttaggtcaaacgcagcaattggagcagtgttcgttgatgaaaaccaatggaactcagcaaaagaagcagtggaagacgaaaggttttgggacctcgtgcacagagagagggagcttcataaacagggaaaatgtgctacgtgtgtctacaatatgatggggaaaagagagaaaaaattaggagagtttggaaaggcaaaaggaagtcgtgcaatatggtacatgtggttgggagcacgctttctagagtttgaagcccttggcttcatgaatgaagaccactggttcagtagagagaattcactcagtggagtggaaggagaaggactacacaaacttggatacatactcagagacatatcaaagattccagggggaaatatgtatgcagatgacacagctggatgggacacaagaataacagaggatgatcttcagaatgaggctaaaatcactgacatcatggagcccgaacatgctctactggctacgtcaatcttcaagctgacctatcaaaataaggtggtaagggtgcaaagaccagcaaaaagtggaaccgtgatggatgttatatccagacgtgaccagagaggaagtggacaggtcggaacttatggcttaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagctctgaatgacatgggaaaagtaagaaaagacataccgcaatgggaaccttcaaaaggatggaatgactggcagcaagtgcctttctgttcacaccatttccaccagctgatcatgaaggatgggagggagatagtggtgccatgccgcaaccaagatgaacttgtgggcagggccagagtatcacaaggcgccggatggagcctgagagaaactgcttgcctaggcaagtcatatgcacaaatgtggcagctgatgtacttccacaggagagacctgagactagcggccaatgctatctgttcagccgttccagttgattgggtcccaaccagccgcaccacctggtcgatccatgcccaccaccaatggatgacaacagaagacatgttatcagtgtggaatagggtttggatagaggaaaacccatggatggaggacaaaactcatgtatccagttgggaagatgttccatacttaggaaaaagggaagatcaatggtgtggatccctgataggcttaacagcaagggccacctgggccaccaacatacaagtggccataaaccaagtgagaaggctcattgggaatgagaattatttagactacatgacatcaatgaagagattcaagaatgagagtgatcccgaaggagccctctggtaa

SEQ ID NO: 39 - DNA, 10179 bp, Dengue virus
atgatcaaccaacgaaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcttaagatttctagccatacccccaacagcaggaattttggctagatggggctcattcaagaagaatggagcgattaaagtgttacggggtttcaagagagaaatctcaaacatgctaaacataatgaacaggaggaaaagatccgtgaccatgctccttatgctgctgcccacagccctggcgttccatctgacgacacgagggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggtttctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagttggcatggtcacactgtacctaggagtcatggttcaggcagattcgggatgtgtaatcaactggaaaggcagagaacttaaatgtggaagcggcatttttgtcactaatgaagttcacacttggacagagcaatacaaattccaggctgactcccccaagagactatcagcagccattgggaaggcatgggaggagggtgtgtgtggaatccgatcagccactcgtctcgagaacatcatgtggaaacaaatatcaaatgaattgaaccacatcctacttgaaaatgacatgaaatttacagtggtcgtgggagatgttagtggaatcttggcccaagggaaaaaaatgattaggccacaacccatggaacacaaatactcgtggaaaagctggggaaaagccaaaatcataggagcggatgtacagaacaccaccttcatcatcgacggcccaaacaccccagaatgccctgacaatcaaagagcatggaatatttgggaagtagaggactatggatttgggattttcacgacaaacatatggttgaaattgcgtgactcctacacccaagtatgtgaccaccggctgatgtcagctgccattaaggacagcaaggcagtccatgctgacatggggtactggatagaaagtgaaaagaacgagacatggaagttggcgagagcctcctttatagaagttaagacatgcatctggccaaaatcccacactctatggagcaatggagttctggaaagtgaaatgataattccaaagatatatggaggaccaatatctcagcacaactacagaccaggatatttcacacaaacagcagggccgtggcacctaggcaagttggaactagatttcgatttttgtgaaggtaccacagttgttgtggatgaacattgtggaaatcgaggaccatctctcagaaccacaacagtcacaggaaagataatccatgaatggtgctgcagatcttgtacgctaccccccctacgtttcaaaggggaagacgggtgttggtacggcatggaaatcagaccagtgaaggacaaggaagagaacctggtcaagtcaatggtctctgcagggtcaggagaagtggacagcttttcactaggactgctatgcatatcaataatgattgaagaagtgatgagatccagatggagcaaaaaaatgctgatgactggaacactggctgtgttcctccttcttataatgggacaattgacatggagtgatctgatcaggttatgtattatggttggagccaacgcttcagacaagatggggatgggaacaacgtacctagctttaatggccactttcaaaatgagaccaatgttcgccgtcgggctattatttcgcagactaacatctagagaagttcttcttcttacaattggcttgagcctggtggcatccgtggagctaccaagttccctagaggagctgggggatggacttgcaataggcatcatgatgttgaaattattgactgattttcagtcacaccagctatgggctactctgctatccttgacatttattaaaacaactttttcattgcactatgcatggaagacaatggctatggtactgtcaattgtatctctcttccctttatgcctgtccacgacctctcaaaaaacaacatggcttccggtgctgttgggatctcttggatgcaaaccactacccatgtttcttataacagaaaacaaaatctggggaaggaagagttggcccctcaatgaaggaattatggctgttggaatagttagtattctactaagttcacttttaaaaaatgatgtgccgctagccggcccattaatagctggaggcatgctaatagcatgttatgtcatatccggaagctcagctgatttatcactggagaaagcggctgaggtctcctgggaggaagaagcagaacactcaggcgcctcacacaacatactagtagaggttcaagatgatggaaccatgaagataaaagatgaagagagagatgacacgctcaccattctccttaaagcaactctgctggcagtctcaggggtgtacccaatgtcaataccagcgaccctttttgtgtggtatttttggcagaaaaagaaacagagatcaggagtgctatgggacacacccagccccccagaagtggaaagagcagttcttgatgatggcatctatagaattttgcaaagaggactgttgggcaggtcccaagtaggagtaggagttttccaagaaggcgtgttccacacaatgtggcacgtcactaggggagctgtcctcatgtatcaaggaaaaaggctggaaccaagctgggccagtgtcaaaaaagacttgatctcatatggaggaggttggaggtttcaaggatcctggaacacgggagaagaagtacaggtgattgctgttgaaccgggaaaaaaccccaaaaatgtacaaacaacgccgggtaccttcaagacccctgaaggcgaagttggagccatagccttagactttaaacctggcacatctggatctcccatcgtaaacagagagggaaaaatagtaggtctttatggaaatggagtggtgacaacaagcggaacttacgttagtgccatagctcaagctaaggcatcacaagaagggcctctaccagagattgaggacgaggtgtttaggaaaagaaacttaacaataatggacctacatccaggatcgggaaaaacaagaagataccttccagccatagtccgtgaggccataaaaaggaagctgcgcacgctaatcctagctcccacaagagttgtcgcttctgaaatggcagaggcactcaagggagtgccaataaggtatcagacaacagcagtgaagagtgaacacacaggaaaggagatagttgaccttatgtgccacgccactttcaccatgcgcctcctgtctcccgtgagagttcccaattataacatgattatcatggatgaagcacacttcaccgatccagccagcatagcagccagagggtacatctcaacccgagtgggtatgggtgaagcagctgcgatctttatgacagccactcccccaggatcggtggaggcctttccacagagcaatgcaattatccaagatgaggaaagagacattcctgagagatcatggaactcaggctatgactggatcactgattttccaggtaaaacagtctggtttgttccaagcatcaaatcaggaaatgacattgccaactgtttaagaaaaaacgggaaacgggtgatccaattgagcagaaaaacctttgacactgagtaccagaaaacaaaaaacaacgactgggactatgtcgtcacaacagacatttccgaaatgggagcaaatttccgggccgacagggtaatagacccaaggcggtgtctgaaaccggtaatactaaaagatggtccagagcgcgtcattctagccggaccgatgccagtgactgtggccagtgccgcccagaggagaggaagaattggaaggaaccaaaacaaggaaggtgatcagtatatttacatgggacagcctttaaacaatgatgaggaccacgctcattggacagaagcaaagatgctccttgacaatataaacacaccagaagggattatcccagccctctatgagccggagagagaaaagagtgcagctatagacggggaatacagactgcggggtgaagcaaggaaaacgttcgtggagctcatgagaagaggggatctaccagtctggctatcctacaaagttgcctcagaaggcttccagtactccgacagaaggtggtgcttcgatggggaaaggaacaaccaggtgttggaggagaacatggacgtggagatctggacaaaagaaggagaaagaaagaaactacgacctcgctggttggacgccagaacatactctgacccactggctctgcgcgagtttaaagagtttgcagcaggaagaagaagcgtctcaggtgacctaatattagaaatagggaaacttccacaacatttgacgcaaagggcccagaatgctttggacaacttggtcatgttgcacaattccgaacaaggaggaaaagcctatagacatgctatggaagaactgccagacacaatagaaacgttgatgctcctagccttgatagctgtgttgactggtggagtgacgctgttcttcctatcaggaagaggtctaggaaaaacatctatcggcttactctgcgtgatggcctcaagcgcactgttatggatggccagtgtggagccccattggatagcggcctccatcatactggagttctttctgatggtactgcttattccagagccagacagacagcgcactccacaggacaaccagctagcatatgtggtgataggtctgttattcatgatattgacagtggcagccaatgagatgggattattggaaaccacaaagaaagacctggggattggccatgtagctgctgaaaaccaccaccatgctacaatgctggacgtagacctacatccagcttcagcctggaccctctatgcagtggccacaacaatcatcactcctatgatgagacacacaattgaaaacacaacggcaaatatttccctgacagccatcgcaaaccaagcagctatattgatgggacttgacaagggatggccaatatcgaagatggacataggagttccacttctcgccttggggtgctattcccaagtgaatccgctgacactgatagcggcagtattgatgctagtagctcattacgccataattggacctggactgcaagcaaaagctactagagaagctcaaaaaagaacagcggctggaataatgaaaaatccaactgtcgacgggattgttgcaatagacttagatcccgtggtttacgatgcaaaatttgaaaaacaactaggccaaataatgttgttgatactttgcacatcacagattcttttgatgcggactacatgggccttgtgtgaatccatcacattggctactggacctctgaccactctttgggagggatctccaggaaaattctggaacaccacaatagcggtatccatggcaaacattttcagggggagttatctagcaggagcaggtctggccttctcattaatgaaatctctaggaggaggtaggagaggcacgggagcccaaggggaaacactgggagaaaaatggaaaagacaactaaaccaactgagcaagtcagaattcaatacttacaagaggagtgggattatggaggtggatagatccgaagccaaagagggactgaaaagaggagaaacaaccaaacacgcagtatcgagaggaacggccaaactgaggtggttcgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccaatcccaatggcgacctatggatggaacctagtaaagctgcactccggaaaagatgtattttttataccacctgagaaatgtgacacccttttgtgtgatattggtgagtcctctccgaacccaactatagaggaaggaagaacgttacgtgttctgaaaatggtggaaccatggctcagaggaaaccaattttgcataaaaattctaaatccctatatgccgagcgtggtagaaactctggaacaaatgcaaagaaaacatggaggaatgctagtgcgaaacccactctcaagaaattccacccatgaaatgtactgggtttcatgtggaacaggaaacattgtgtcagcagtaaacatgacatctagaatgttgctaaatcggttcacaatggctcacaggaagccaacatatgaaagagacgtggacttaggcgctggaacaagacatgtggcagtagaaccagaggtagccaacctagatatcattggccagaggatagagaatataaaaaatgaacataagtcaacatggcattatgatgaggacaatccatacaaaacatgggcctatcatggatcatatgaggttaagccatcaggatcggcctcatccatggtcaatggcgtggtgagattgctcaccaaaccatgggatgttatccccatggtcacacaaatagccatgactgataccacaccctttggacaacagagggtgtttaaagagaaagttgacacgcgcacaccaaaagcaaaacgtggcacagcacaaattatggaagtgacagccaggtggttatggggtttcctttctagaaacaaaaaacccagaatttgcacaagagaggagtttacaagaaaagttaggtcaaacgcagctattggagcagtgttcgttgatgaaaatcaatggaactcggcaaaagaagcagtggaagacgaacggttctgggaacttgtccacagagagagggagcttcataaacaggggaaatgtgccacgtgtgtctacaatatgatggggaagagagagaaaaaattaggagagttcggaaaggcaaaaggaagtcgtgcaatatggtacatgtggttgggagcacgcttcctagagtttgaagcccttggtttcatgaatgaagatcactggttcagtagagagaattcactcagtggagtggaaggagaaggactccacaaacttggatacatactcagagacatatcaaggattccaggggggaacatgtatgcagatgacacagccggatgggacacaagaataacagaggatgatctccagaatgaggctaaaatcactgacatcatggagcccgaacatgccctgctggctacgtcaatctttaagctgacctaccaaaataaggtggtaagggtgcagagaccagcaaaaaatggaaccgtgatggatgttatatccagacgtgaccagagaggcagtggacaggttggaacttatggcttaaacactttcaccaacatggaggcccaactgataagacaaatggagtccgagggaatctttttacccagcgaattggaaaccccaaatctagccggaagagttctcgactggttggaaaaatatggtgtcgaaaggctgaaaagaatggcaatcagcggagatgactgtgtggtgaaaccaattgatgacaggttcgcaacagccttaacagctttgaatgacatgggaaaagtaagaaaagacataccacaatgggaaccttcaaaaggatggaatgattggcaacaagtgcctttctgttcacaccacttccaccagctaattatgaaggatgggagggagatagtggtgccatgccgcaaccaagatgaacttgtggggagggccagagtatcacaaggcgccggatggagcctgagagaaaccgcatgcctaggcaagtcatatgcacaaatgtggcagctgatgtatttccacaggagagacctgagactggcggctaacgctatttgttcagccgttccagttgattgggtcccaaccagccgcaccacctggtcgatccatgcccatcaccaatggatgacaacagaagacatgttatcagtatggaatagggtctggatagaggaaaacccatggatggaggataagactcatgtgtccagttgggaagaagttccatacctaggaaagagggaagatcagtggtgtggatccctgataggcttaacagcaagggccacctgggccactaatatacaagtggccataaaccaagtgagaaggctcattgggaatgagaattatctagattacatgacatcaatgaagagattcaagaatgagagtgatcccgaaggggcactctggtaa

SEQ ID NO: 40 - DNA, 10179 bp, Dengue virus
atgatcaaccaacgaaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcttaagatttctagccatacccccaacagcaggaattttggctagatggggctcattcaagaagaatggagcgattaaagtgttacggggtttcaagagagaaatctcaaacatgctaaacataatgaacaggaggaaaagatccgtgaccatgctccttatgctgctgcccacagccctggcgttccatctgacgacacgagggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagctcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaaaagaaatcatggcttgtccacaaacagtggtttctagacttaccactgccttggacctctggggctttaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcggtgatgtgcatcgcagttggcatggtcacactgtacctaggagtcatggttcaggcagattcgggatgtgtaatcaactggaaaggcagagaacttaaatgtggaagcggcatttttgtcactaatgaagttcacacttggacagagcaatacaaattccaggctgactcccccaagagactatcagcagccattgggaaggcatgggaggagggtgtgtgtggaatccgatcagccactcgtctcgagaacatcatgtggaaacaaatatcaaatgaattgaaccacatcctacttgaaaatgacatgaaatttacagtggtcgtgggagacgttagtggaatcttggcccaagggaaaaaaatgattaggccacaacccatggaacacaaatactcgtggaaaagctggggaaaagctaaaatcataggagcggatgtacagaacaccaccttcatcatcgacggcccaaacaccccagaatgccctgacaatcaaagagcatggaatatttgggaagtagaggactatggatttgggattttcacgacaaacatatggttgaaattgcgtgactcctacacccaagtatgtgaccaccggctgatgtcagctgccattaaggacagcaaggcagtccatgctgacatggggtactggatagaaagtgaaaagaacgagacatggaagttggcgagagcctcctttatagaagttaagacatgcatctggccaaaatcccacactctatggagcaatggagttctggaaagtgaaatgataattccaaagatatatggaggaccaatatctcagcacaactacagaccaggatatttcacacaaacagcagggccgtggcacctaggcaagttggaactagatttcgatttttgtgaaggtaccacagttgttgtggatgaacattgtggaaatcgaggaccatctctcagaaccacaacagtcacaggaaagataatccatgaatggtgctgcagatcttgtacgctaccccccctacgtttcaaaggggaagacgggtgttggtacggcatggaaatcagaccagtgaaggacaaggaagagaacctggtcaagtcaatggtctctgcagggtcaggagaagtggacagcttttcactaggactgctatgcatatcaataatgattgaagaagtgatgagatccagatggagcaaaaaaatgctgatgactggaacactggctgtgttcctccttcttataatgggacaattgacatggagtgatctgatcaggttatgtattatggttggagccaacgcttcagacaagatggggatgggaacaacgtacctagctttaatggccactttcaaaatgagaccaatgttcgccgtcgggctattatttcgcagactaacatctagagaagttcttcttcttacaattggcttgagcctggtggcatccgtggagctaccaagttccctagaggagctgggggatggacttgcaataggcatcatgatgttgaaattattgactgattttcagtcacaccagctatgggctactctgctatccttgacatttattaaaacaactttttcattgcactatgcatggaagacaatggctatggtactgtcaattgtatctctcttccctttatgcctgtccacgacctctcaaaaaacaacatggcttccggtgctgttgggatctcttggatgcaaaccactacccatgtttcttataacagaaaacaaaatctggggaaggaagagttggcccctcaatgaaggaattatggctgttggaatagttagtattctactaagttcacttttaaaaaatgatgtgccgctagccggcccattaatagctggaggcatgctaatagcatgttatgtcatatccggaagctcagctgatttatcactggagaaagcggctgaggtctcctgggaggaagaagcagaacactcaggcgcctcacacaacatactagtagaggttcaagatgatggaaccatgaagataaaagatgaagagagagatgacacgctcaccattctccttaaagcaactctgctggcagtctcaggggtgtacccaatgtcaataccagcgaccctttttgtgtggtatttttggcagaaaaagaaacagagatcaggagtgctatgggacacacccagccccccagaagtggaaagagcagttcttgatgatggcatctatagaattttgcaaagaggactgttgggcaggtcccaagtaggagtaggagttttccaagaaggcgtgttccacacaatgtggcacgtcactaggggagctgtcctcatgtatcaaggaaaaaggctggaaccaagctgggccagtgtcaaaaaagacttgatctcatatggaggaggttggaggtttcaaggatcctggaacacgggagaagaagtacaggtgattgctgttgaaccgggaaaaaaccccaaaaatgtacaaacaacgccgggtaccttcaagacccctgaaggcgaagttggagccatagccttagactttaaacctggcacatctggatctcccatcgtaaacagagagggaaaaatagtaggtctttatggaaatggagtggtgacaacaagcggaacttacgttagtgccatagctcaagctaaggcatcacaagaagggcctctaccagagattgaggacaaggtgtttaggaaaagaaacttaacaataatggacctacatccaggatcgggaaaaacaagaagataccttccagccatagtccgtgaggccataaaaaggaagctgcgcacgctaatcctagctcccacaagagttgtcgcttctgaaatggcagaggcactcaagggagtgccaataaggtatcagacaacagcagtgaagagtgaacacacaggaaaggagatagttgaccttatgtgccacgccactttcaccatgcgcctcctgtctcccgtgagagttcccaattataacatgattatcatggatgaagcacacttcaccgatccagccagcatagcagccagagggtacatctcaacccgagtgggtatgggtgaagcagctgcgatctttatgacagccactcccccaggatcggtggaggcctttccacagagcaatgcaattatccaagatgaggaaagagacattcctgagagatcatggaactcaggctatgactggatcactgattttccaggtaaaacagtctggtttgttccaagcatcaaatcaggaaatgacattgccaactgtttaagaaaaaacgggaaacgggtgatccaattgagcagaaaaacctttgacactgagtaccagaaaacaaaaaacaacgactgggactatgtcgtcacaacagacatttccgaaatgggagcaaatttccgggccgacagggtaatagacccaaggcggtgtctgaaaccggtaatactaaaagatggtccagagcgcgtcattctagccggaccgatgccagtgactgtggccagtgccgcccagaggagaggaagaattggaaggaaccaaaacaaggaaggtgatcagtatatttacatgggacagcctttaaacaatgatgaggaccacgctcattggacagaagcaaagatgctccttgacaatataaacacaccagaagggattatcccagccctctttgagccggagagagaaaagagtgcagctatagacggggaatacagactgcggggtgaagcaaggaaaacgttcgtggagctcatgagaagaggggatctaccagtctggctatcctacaaagttgcctcagaaggcttccagtactccgacagaaggtggtgcttcgatggggaaaggaacaaccaggtgttggaggagaacatggacgtggagatctggacaaaagaaggagaaagaaagaaactacgacctcgctggttggacgccagaacatactctgacccactggctctgcgcgagtttaaagagtttgcagcaggaagaagaagcgtctcaggtgacctaatattagaaatagggaaacttccacaacatttgacgcaaagggcccagaatgctttggacaacttggtcatgttgcacaattccgaacaaggaggaaaagcctatagacatgctatggaagaactgccagacacaatagaaacgttgatgctcctagccttgatagctgtgttgactggtggagtgacgctgttcttcctatcaggaagaggtctaggaaaaacatctatcggcttactctgcgtgatggcctcaagcgcactgttatggatggccagtgtggagccccattggatagcggcctccatcatactggagttctttctgatggtactgcttattccagagccagacagacagcgcactccacaggacaaccagctagcatatgtggtgataggtctgttattcgtgatattgacagtggcagccaatgagatgggattattggaaaccacaaagaaagacctggggattggccatgtagctgctgaaaaccaccaccatgctacaatgctggacgtagacctacatccagcttcagcctggaccctctatgcagtggccacaacaatcatcactcctatgatgagacacacaattgaaaacacaacggcaaatatttccctgacagccatcgcaaaccaagcagctatattgatgggacttgacaagggatggccaatatcgaagatggacataggagttccacttctcgccttggggtgctattcccaagtgaatccgctgacactgatagcggcagtattgatgctagtagctcattacgccataattggacctggactgcaagcaaaagctactagagaagctcaaaaaagaacagcggctggaataatgaaaaatccaactgtcgacgggattgttgcaatagacttagatcccgtggtttacgatgcaaaatttgaaaaacagctaggccaaataatgttgttgatactttgcacatcacagattcttttgatgcggactacatgggccttgtgtgaatccatcacattggctactggacctctgaccactctttgggagggatctccaggaaaattctggaacaccacaatagcggtatccatggcaaacattttcagggggagttatctagcaggagcaggtctggccttctcattaatgaaatctctaggaggaggtaggagaggcacgggagcccaaggggaaacactgggagaaaaatggaaaagacaactaaaccaactgagcaagtcagaattcaatacttacaagaggagtgggattatggaggtggatagatccgaagccaaagagggactgaaaagaggagaaacaaccaaacacgcagtatcgagaggaacggccaaactgaggtggttcgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccaatcccaatggcgacctatggatggaacctagtaaagctgcactccggaaaagatgtattttttataccacctgagaaatgtgacacccttttgtgtgatattggtgagtcctctccgaacccaactatagaggaaggaagaacgttacgtgttctgaaaatggtggaaccatggctcagaggaaaccaattttgcataaaaattctaaatccctatatgccgagcgtggtagaaactctggaacaaatgcaaagaaaacatggaggaatgctagtgcgaaacccactctcaagaaattccacccatgaaatgtactgggtttcatgtggaacaggaaacattgtgtcagcagtaaacatgacatctagaatgttgctaaatcggttcacaatggctcacaggaagccaacatatgaaagagacgtggacttaggcgctggaacaagacatgtggcagtagaaccagaggtagccaacctagatatcattggccagaggatagagaatataaaaaatgaacataagtcaacatggcattatgatgaggacaatccatacaaaacatgggcctatcatggatcatatgaggttaagccatcaggatcggcctcatccatggtcaatggcgtggtgagattgctcaccaaaccatgggatgttatccccatggtcacacaaatagccatgactgataccacaccctttggacaacagagggtgtttaaagagaaagttgacacgcgcacaccaaaagcaaaacgtggcacagcacaaattatggaagtgacagccaggtggttatggggtttcctttctagaaacaaaaaacccagaatttgcacaagagaggagtttacaagaaaagttaggtcaaacgcagctattggagcagtgttcgttgatgaaaatcaatggaactcggcaaaagaagcagtggaagacgaacggttctgggaacttgtccacagagagagggagcttcataaacaggggaaatgtgccacgtgtgtctacaatatgatggggaagagagagaaaaaattaggagagttcggaaaggcaaaaggaagtcgtgcaatatggtacatgtggttgggagcacgcttcctagagtttgaagcccttggtttcatgaatgaagatcactggttcagtagagagaattcactcagtggagtggaaggagaaggactccacaaacttggatacatactcagagacatatcaaggattccaggggggaacatgtatgcagatgacacagccggatgggacacaagaataacagaggatgatctccagaatgaggctaaaatcactgacatcatggagcccgaacatgccctgctggctacgtcaatctttaagctgacctaccaaaataaggtggtaagggtgcagagaccagcaaaaaatggaaccgtgatggatgttatatccagacgtgaccagagaggcagtggacaggttggaacttatggcttaaacactttcaccaacatggaggcccaactgataagacaaatggagtctgagggaatctttttacccagcgaattggaaaccccaaatctagccggaagagttctcgactggttggaaaaatatggtgtcgaaaggctgaaaagaatggcaatcagcggagatgactgtgtggtgaaaccaattgatgacaggttcgcaacagccttaacagctttgaatgacatgggaaaagtaagaaaagacataccacaatgggaaccttcaaaaggatggaatgattggcaacaagtgcctttctgttcacaccacttccaccagctaattatgaaggatgggagggagatagtggtgccatgccgcaaccaagatgaacttgtggggagggccagagtatcacaaggcgccggatggagcctgagagaaaccgcatgcctaggcaagtcatatgcacaaatgtggcagctgatgtatttccacaggagagacctgagactggcggctaacgctatttgttcagccgttccagttgattgggtcccaaccagccgcaccacctggtcgatccatgcccatcaccaatggatgacaacagaagacatgttatcagtatggaatagggtctggatagaggaaaacccatggatggaggataagactcatgtgtccagttgggaagaagttccatacctaggaaagagggaagatcagtggtgtggatccctgataggcttaacagcaagggccacctgggccactaatatacaagtggccataaaccaagtgagaaggctcattgggaatgagaattatctagattacatgacatcaatgaagagattcaagaatgagagtgatcccgaaggggcactctggtaa

SEQ ID NO: 41 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcgatcaaagtgttgcggggtttcaaaaaagagatctcaagcatgttgaacataatgaacaggaggaaaagatccgtgaccatgctcctcatgctgctgcccacagccctggcgttccatttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacatccaggattcacagtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccactatggcaaaaaataaaccaacattggacattgaactcttgaagacggaggtcacgaaccctgccgtcttgcgcaaattgtgcattgaagccaaaatatcaaacaccaccaccgattcaagatgtccaacacaaggagaggccacactggtggaagaacaagacgcgaactttgtgtgtcgccgaacgtttgtggacagaggctggggtaatggctgcggattattcggaaaaggaagcctattgacgtgtgccaagtttaagtgtgtgacaaaactagaaggaaagatagttcaatatgaaaacttgaaatattcagtgatagtcaccgtccacactggggatcagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagttgtactgggatcacaagaaggagcaatgcacaccgcgttgactggggcgacagaaatccagacgtcaggaacgacaacaatctttgcagggcacctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagatgcgccatgcaagatcccctttttgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctctgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgtagttggcatggttacactgtacctaggagtcatggttcaagcggactcgggatgtgtaatcaactggaagggcagagaactcaaatgtggaagtggcatctttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctaatggaattttggcccaagggaaaaaaatgattaggccacaacccatggaacacaaatattcatggaaaagctggggaaaagctaaaatcataggagcagacatacaaaacaccaccttcatcatcgacggcccagatactccagaatgccccaatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagcgaaaagaacgaaacctggaagctggcgagagcctcgttcatagaagtcaagacatgcatctggccgaaatcccacactctatggagtaatggagttttggaaagtgaaatgataatcccaaagatgtatggaggaccaatatctcagcacaactacagaccagggtatttcacacaaacagcagggccatggcatctaggcaagctggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgcttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacatcagttatggaccaccttactgtctctgacatttatcaaaacaactctttcattggattacgcatggaagacaacggctatggtgctgtcaatcgtatctctctttcctttatgcctgtctacgacctctcaaaaaacaacatggcttccggtgctgttaggatcttttggatgcaaaccattaaccatgtttctcataacagaaaacgaaatctggggaagaaaaagttggcccctcaatgaaggaattatggctgttggaatagtcagcattctactgagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgacgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtgcagacaacgccgggtaccttcaagactcctgaaggcgaagttggagccatagctctagattttaaacccggcacatctggatctcccatcgtaaacagagagggaaaaatagtaggtctttatggaaatggagtggtgacaacaagtggaacctacgtcagtgccatagcccaagctaaagcatcacaggaagggcctctaccagagattgaggacgaggtgttcaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaataccaataagatatcagacaacagcagtgaagagtgagcacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgactgggactatgttgtcacaacagacatttccgaaatgggggcaaatttccgggctgacagggtaatagacccaaggcggtgcttgaaaccggtaatactaaaagatggtccagagcgtgtcattctagccggaccgatgccagtgactgtggccagtgcagcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgccatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattgttggaaaccacaaagaaagacctggggattggccatgtagccgccgaaaaccaccaacatgctacaatgctggacgtagacctacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttacaatagacttagatcctgtggtttatgatgcaaaatttgaaaaacagctaggccaaataatgttactgatactttgtacatcacagatcctcttaatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactaggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcaagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggcgggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgaggttgctcacaaaaccatgggatgttatccccatggtcacacaaatagctatgactgataccacaccctttggacaacagagagtgtttaaagagaaggttgacacgcgcacaccaagagcgaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactccacaaacttggatacatactcagagacatatcaaagattccggggggaaatatgtatgcagatgatacagccggatgggacacaagaataacagaggatgatcttcggaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccgtgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 42 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcgggccaaggacccatgaaattggtgatggcttttatagcatttctaagatttctagccatacccccaacagcaggaattttggctagatggagctcattcaagaagaatggagcgatcaaagtgttacggggtttcaaaaaagagatctcaagcatgttgaatattatgaacaggaggaaaaaatctgtgaccatgctcctcatgctgctgcccacagccctggcgttccatttgaccacacgagggggagagccacacatgatagttagcaagcaggaaagaggaaagtcactgttgtttaagacctctgcaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccttttttttagcacatgccataggaacatccattactcagaaagggatcattttcattttgctgatgctagtaacaccatcaatggccatgcgatgtgtgggaataggcaacagggacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagctctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcattgactggggcgacagaaatccagacgtcaggaacgacaacgatctttgcaggacacctgaaatgcagactaaaaatggataaactgactttaaaagggatgtcatatgtaatgtgcacaggctcattcaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtgcaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaaaggcagagaactcaaatgtggaagtggtatttttgtcaccaatgaagtccacacttggacagagcaatacaaattccaggctgactccccaaaaagactgtcagcagccatagggaaggcatgggaagagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggcccatctctcagaactacaacagtcacaggaaagataatccatgaatggtgctgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtggcatccgtggagttaccaaattctttggaggagctaggggatggacttgcaatgggtattatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacattctggcacctcacacaacatattagtagaggtccaagatgatggaactatgaaaataaaggatgaagagagggatgacacactcaccatactcctcaaagcaactttgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtaggagtgggagttttccaggacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagctatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcacccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccatgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaattcaggctacgactggatcactgattttccaggtaaaacagtctggtttgttccaagcatcaagtcaggaaatgacattgctaactgtttaagaaagaacggaaaacgggtgatccaattgagcagaaaaacctttgacactgagtaccagaaaacaagaaacaatgactgggactatgtcgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggagggaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattagaaaccacaaagaaagacctggggattggccatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagaaggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatactattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagacacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggccaaaatcactgacatcatggagcctgaacacgctctattagctacgtcaatttttaagctgacctaccaaaacaaggtggtaagggtgcaaagaccagcaaaaaatggaaccgtgatggatgttatatccagacgagaccagagaggaagtgggcaggtcggaacctatggcctaaatactttcaccaatatggaggtccaactaataagacaaatggagtctgaaggaatttttttacccagcgaattggaaacccccaatctagctgagagagttcttaactggttggaaaaacatggtactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggttccaaccagccgcacaacctggtcaatccatgctcaccatcaatggatgacaacagaagatatgttatcagtgtggaatagggtttggatagaggaaaacccatggatggaggataaaactcatgtatccagctgggaagaagtcccatacttagggaaaagggaagatcaatggtgtggatccctgataggcttgacagcgagggccacttgggccactaacatacaagttgccataaaccaagtgagaaggctcatcggaaatgagaattatctagattacatgacatcaatgaagagattcaagaatgagagtgatcccgaaggggcactctggtaa

SEQ ID NO: 43 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcgggccaaggacccatgaaattggtgatggcttttatagcatttctaagatttctagccatacccccaacagcaggaattttggctagatggagctcattcaagaagaatggagcgatcaaagtgttacggggtttcaaaaaagagatctcaagcatgttgaatattatgaacaggaggaaaaaatctgtgaccatgctcctcatgctgctgcccacagccctggcgttccatttgaccacacgagggggagagccacacatgatagttagtaagcaggaaagaggaaagtcactgttgtttaagacctctgcaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagggacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaagctagaaggaaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcattgactggggcgacagaaatccagacgtcaggaacgacaacgatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacatcgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtaggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaaaggcagagaactcaaatgtggaagtggtatttttgtcaccaatgaagtccacacttggacagagcaatacaaattccaggctgactccccaaaaagactgtcagcagccatagggaaggcatgggaagagggcgtgtgtggaattcgatcagccacgcgtcttgagaacatcatgtggaagcaaatatcaaatgaattgaaccacattctacttgaaaatgacatgaagttcacagtggttgtaggagatgctaatggaattttggcccaagggaaaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccgaaatctcacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggcccatctctcagaactacaacagtcacaggaaagataatccatgaatggtgctgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactacttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacattctggtacctcacacaacatattagtagaggtccaagatgatggaactatgaaaataaaggatgaagagagggatgacacactcaccatactcctcaaagcaactttgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaagtcccaagtaggagtgggagttttccaggacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagctatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcacccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccatgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaattcaggctacgactggatcactgattttccaggtaaaacagtctggtttgttccaagcatcaagtcaggaaatgacattgctaactgtttaagaaagaacggaaaacgggtgatccaattgagcagaaaaacctttgacactgagtaccagaaaacaagaaacaatgactgggactatgtcgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggagggaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattagaaaccacaaagaaagacctggggattggccatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagaaggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatactattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaaccatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggccaaaatcactgacatcatggagcctgaacacgctctattagctacgtcaatttttaagctgacctaccaaaacaaggtggtaagggtgcaaagaccagcaaaaaatggaaccgtgatggatgttatatccagacgagaccagagaggaagtgggcaggtcggaacctatggcctaaatactttcaccaatatggaggtccaactaataagacaaatggagtctgaaggaattattttacccagcgaattggaaacccccaatctagctgagagagttcttaactggttggaaaaacatggtactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggttccaaccagccgcacaacctggtcaatccatgctcaccatcaatggatgacaacagaagatatgttatcagtgtggaatagggtttggatagaggaaaacccatggatggaggataaaactcatgtatccagctgggaagaagtcccatacttagggaaaagggaagatcaatggtgtggatccctgataggcttgacagcgagggccacttgggccactaacatacaagttgccataaaccaagtgagaaggctcatcggaaatgagaattatctagattacatgacatcaatgaagagattcaagaatgagagtgatcccgaaggggcactctggtaa

SEQ ID NO: 44 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcgatcaaagtgttgcggggtttcaaaaaagagatctcaagcatgttgaacataatgaacaggaggaaaagatccgtgaccatgctcctcatgctgctgcccacagccctggcgttccatttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacatccaggattcacagtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccactatggcaaaaaataaaccaacattggacattgaactcttgaagacggaggtcacgaaccctgccgtcttgcgcaaattgtgcattgaagccaaaatatcaaacaccaccaccgattcaagatgtccaacacaaggagaggccacactggtggaagaacaagacgcgaactttgtgtgtcgccgaacgtttgtggacagaggctggggtaatggctgcggattattcggaaaaggaagcctattgacgtgtgccaagtttaagtgtgtgacaaaactagaaggaaagatagttcaatatgaaaacttgaaatattcagtgatagtcaccgtccacactggggatcagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagttgtactgggatcacaagaaggagcaatgcacaccgcgttgactggggcgacagaaatccagacgtcaggaacgacaacaatctttgcagggcacctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagatgcgccatgcaagatcccctttttgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctctgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgtagttggcatggttacactgtacctaggagtcatggttcaagcggactcgggatgtgtaatcaactggaagggcagagaactcaaatgtggaagtggcatctttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctaatggaattttggcccaagggaaaaaaatgattaggccacaacccatggaacacaaatactcatggaaaagctggggaaaagccaaaatcataggagcagacatacaaaacaccaccttcatcatcgacggcccagatactccagaatgccccaatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagcgaaaagaacgaaacctggaagctggcgagagcctcgttcatagaagtcaagacatgcatctggccgaaatcccacactctatggagtaatggagttttggaaagtgaaatgataatcccaaagatgtatggaggaccaatatctcagcacaactacagaccagggtatttcacacaaacagcagggccatggcatctaggcaagctggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgcttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacatcagttatggaccaccttactgtctctgacatttatcaaaacaactctttcattggattacgcatggaagacaacggctatggtgctgtcaatcgtatctctctttcctttatgcctgtctacgacctctcaaaaaacaacatggcttccggtgctgttaggatcttttggatgcaaaccattaaccatgtttctcataacagaaaacgaaatctggggaagaaaaagttggcccctcaatgaaggaattatggctgttggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgacgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtgcagacaacgccgggtaccttcaagactcctgaaggcgaagttggagccatagctctagattttaaacccggcacatctggatctcccatcgtaaacagagagggaaaaatagtaggtctttatggaaatggagtggtgacaacaagtggaacctacgtcagtgccatagcccaagctaaagcatcacaggaagggcctctaccagagattgaggacgaggtgttcaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaataccaataagatatcagacaacagcagtgaagagtgagcacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgactgggactatgttgtcacaacagacatttccgaaatgggggcaaatttccgggctgacagggtaatagacccaaggcggtgcttgaaaccggtaatactaaaagatggtccagagcgtgtcattctagccggaccgatgccagtgactgtggccagtgcagcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggcgacctaatattggaaatagggaaacttccacaacatttgacgctaagagcccagaatgctctggataacttggtcatgttgcataattccgaacaaggaggaaaagcctatagacatgccatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagtgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattgttggaaaccacaaagaaagacctggggattggccatgtagccgccgaaaaccaccaacatgctacaatgctggacgtagacctacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttacaatagacttggatcctgtggtttatgatgcaaaatttgaaaaacagctaggccaaataatgttactgatactttgtacatcacagatcctcttaatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactaggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcaagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggcgggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgaggttgctcacaaaaccatgggatgttatccccatggtcacacaaatagctatgactgataccacaccctttggacaacagagagtgtttaaagagaaggttgacacgcgcacaccaagagcgaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcggaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccgtgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 45 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcgggccaaggacccatgaaattggtgatggcttttatagcatttctaagatttctagccatacccccaacagcaggaattttggctagatggagctcattcaagaagaatggagcgatcaaagtgttacggggtttcaaaaaagagatctcaagcatgttgaatattatgaacaggaggaaaaaatctgtgaccatgctcctcatgctgctgcccacagccctggcgttccatttgaccacacgagggggagagccacacatgatagttagtaagcaggaaagaggaaagtcactgttgtttaagacctctgcaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagggacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaagctagaaggaaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcattgactggggcgacagaaatccagacgtcaggaacgacaacgatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacatcgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtaggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaaaggcagagaactcaaatgtggaagtggtatttttgtcaccaatgaagtccacacttggacagagcaatacaaattccaggctgactccccaaaaagactgtcagcagccatagggaaggcatgggaagagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggagaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccgaaatctcacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggcccatctctcagaactacaacagtcacaggaaagataatccatgaatggtgctgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcgtgttatgtcatatccggaagctcagccgatttatcattggagaaagcggctgaggtatcctgggaagaagaagcagaacattctggtacctcacacaacatattagtagaggtccaagatgatggaactatgaaaataaaggatgaagagagggatgacacactcaccatactcctcaaagcaactttgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaagtcccaagtaggagtgggagttttccaggacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagctatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcacccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccatgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaattcaggctacgactggatcactgattttccaggtaaaacagtctggtttgttccaagcatcaagtcaggaaatgacattgctaactgtttaagaaagaacggaaaacgggtgatccaattgagcagaaaaacctttgacactgagtaccagaaaacaagaaacaatgactgggactatgtcgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggagggaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattagaaaccacaaagaaagacctggggattggccatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagaaggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatactattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggccaaaatcactgacatcatggagcctgaacacgctctattagctacgtcaatttttaagctgacctaccaaaacaaggtggtaagggtgcaaagaccagcaaaaaatggaaccgtgatggatgttatatccagacgagaccagagaggaagtgggcaggtcggaacctatggcctaaatactttcaccaatatggaggtccaactaataagacaaatggagtctgaaggaattattttacccagcgaattggaaacccccaatctagctgagagagttcttaactggttggaaaaacatggtactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggttccaaccagccgcacaacctggtcaatccatgctcaccatcaatggatgacaacagaagatatgttatcagtgtggaatagggtttggatagaggaaaacccatggatggaggataaaactcatgtatccagctgggaagaagtcccatacttagggaaaagggaagatcaatggtgtggatccctgataggcttgacagcgagggccacttgggccactaacatacaagttgccataaaccaagtgagaaggctcatcggaaatgagaattatctagattacatgacatcaatgaagagattcaagaatgagagtgatcccgaaggggcactctggtaa

SEQ ID NO: 46 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcgatcaaagtgttgcggggtttcaaaaaagagatctcaagcatgttgaacataatgaacaggaggaaaagatccgtgaccatgctcctcatgctgctgcccacagccctggcgttccatttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacatccaggattcacagtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccactatggcaaaaaataaaccaacattggacattgaactcttgaagacggaggtcacgaaccctgccgtcttgcgcaaattgtgcattgaagccaaaatatcaaacaccaccaccgattcaagatgtccaacacaaggagaggccacactggtggaagaacaagacgcgaactttgtgtgtcgccgaacgtttgtggacagaggctggggtaatggctgcggattattcggaaaaggaagcctattgacgtgtgccaagtttaagtgtgtgacaaaactagaaggaaagatagttcaatatgaaaacttgaaatattcagtgatagtcaccgtccacactggggatcagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagttgtactgggatcacaagaaggagcaatgcacaccgcgttgactggggcgacagaaatccagacgtcaggaacgacaacaatctttgcagggcacctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagatgcgccatgcaagatcccctttttgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctctgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgtagttggcatggttacactgtacctaggagtcatggttcaagcggactcgggatgtgtaatcaactggaagggcagagaactcaaatgtggaagtggcatctttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctaatggaattttggcccaagggaaaaaaatgattaggccacaacccatggaacacaaatactcatggaaaagctggggaaaagctaaaatcataggagcagacatacaaaacaccaccttcatcatcgacggcccagatactccagaatgccccaatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagcgaaaagaacgaaacctggaagctggcgagagcctcgttcatagaagtcaagacatgcatctggccgaaatcccacactctatggagtaatggagttttggaaagtgaaatgataatcccaaagatgtatggaggaccaatatctcagcacaactacagaccagggtatttcacacaaacagcagggccatggcatctaggcaagctggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgcttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattgtttcgcagactaacatccagagaagttcttcttctcacgattggattaagcctggtggcatccgtggagctaccaaattctttggaggagctaggggatggacttgcaatgggtatcatgatgttaaaattattgactgaatttcagccacatcagttatggaccaccttactgtctctgacatttatcaaaacaactctttcattggattacgcatggaagacaacggctatggtgctgtcaatcgtatctctctttcctttatgcctgtctacgacctctcaaaaaacaacatggcttccggtgctgttaggatcttttggatgcaaaccattaaccatgtttctcataacagaaaacgaaatctggggaagaaaaagttggcccctcaatgaaggaattatggctgttggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgacgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtgcagacaacgccgggtaccttcaagactcctgaaggcgaagttggagccatagctctagattttaaacccggcacatctggatctcccatcgtaaacagagagggaaaaatagtaggtctttatggaaatggagtggtgacaacaagtggaacctacgtcagtgccatagcccaagctaaagcatcacaggaagggcctctaccagagattgaggacgaggtgttcaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaataccaataagatatcagacaacagcagtgaagagtgagcacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgactgggactatgttgtcacaacagacatttccgaaatgggggcaaatttccgggctgacagggtaatagacccaaggcggtgcttgaaaccggtaatactaaaagatggtccagagcgtgtcattctagccggaccgatgccagtgactgtagccagtgcagcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgccatggaggaactaccagacaccatagaaacattgatgctcctagctttgatagctgtgttgactggtggagtgacgttgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattgttggaaaccacaaagaaagacctggggattggccatgtagccgccgaaaaccaccaacatgctacaatgctggacgtagacctacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttacaatagacttggatcctgtggtttatgatgcaaaatttgaaaaacagctaggccaaataatgttactgatactttgcacatcacagatcctcttaatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactaggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcaagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggcgggatgctagtgcgaaacccactttcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatggtgaagacaatccatacaaaacatgggcctatcatggatcatatgaggttaagccatcaggatcagcctcatctatggtgaatggagtggtgaggttgctcacaaaaccatgggatgttatccccatggtcacacaaatagctatgactgataccacaccctttggacaacagagagtgtttaaagagaaggttgacacgcgcacaccaagagcgaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcataaacttggatacatactcagagacatatcaaagattccggggggaaatatgtatgcagatgatacagccggatgggacacaagaataacagaggatgatcttcggaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccgtgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 47 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaacatttctagccatacccccaacagcaggaattttggctagatggggctcattcaagaagaatggagcgatcaaagtgttacggggtttcaagaaagaaatttcaaacatgttgaatataatgaacagaaggaagagatccgtgaccatgctccttatgctgctgcccacagtcttggcgtttcatctgaccacacgagggggagagccgcatatgatagttaccaagcaagaaagaggaaagtcacttttgtttaagacctcaactggtgtcaacatgtgcacccttattgcgatggatttgggagagttatgtgaggatacaatgacttacaaatgtcctcgaatcactgaggcggaaccagatgacgttgactgctggtgcaatgccacagacacatgggtgacctatggaacgtgttcccaaactggcgagcaccgacgggacaaacgttccgtcgcactggctccacacgtgggacttggtctagaaacaagaaccgaaacgtggatgtcctctgaaggcgcttggaaacaaatacaaagagtggagacttgggccctgagacacccaggatttacagtgacagccctttttcttgcacatgccataggaacatccatcacccagaaagggattattttcattttgttgatgttggtaacaccatccatggccatgcgatgtgtgggaataggcaacagggactttgtggaaggactgtcgggagcaacgtgggtagatgtggtactggaacatggaagctgtgtcaccaccatggcaaaagataaaccaacattggacattgaactcttgaagacggaagtcacaaaccctgccgtcctgcgcaaactgtgcattgaagccaaaatatcaaacaccaccaccgattcaagatgtccaacacaaggagaagccacactggtggaagaacaagacgcgaattttgtgtgtcgacgaacgtttgtggacagaggctggggcaatggctgtgggcttttcgggaaaggtagcctaataacgtgtgctaagttcaagtgtgtgacaaaattggaaggaaagatagttcaatatgaaaacttgaaatattcagtaatagtcaccgtccacactggagaccagcaccaggtgggaaatgaaagcacagaacatgggacaacagcaaccataacacctcaagctcccacgtcggaaatacagctgaccgactacggagctcttacattggactgctcacctagaacaggactagacttcaatgaaatggtgttgttgacaatgaaagaaaaatcatggctagtccacaaacaatggtttctagacctaccactgccttggacctcgggagctacaacgtcacaagagacttggaacagacaagatttgctggtaacattcaagacagctcatgcaaagaagcaggaagtggtcgtactaggatcacaagaaggagcaatgcacactgcgttgaccggagcgacagaaatccaaacgtctggaacgacaacgatttttgcaggacacttgaaatgtagactaaaaatggacaaactgactctaaaagggatgtcatatgtgatgtgcacaggctcattcaagctagagaaagaggtggctgagacccagcatggaaccgtcctagtgcaggttaaatacgaaggaacagatgcaccatgcaagatccctttttcgacccaagatgaaaaaggagtaacccagaatgggagagtgataacagccaaccctatagtcactgacaaggaaaaaccagtcaacattgaggcagaaccaccttttggtgagagttacatcgtggtaggagcaggtgaaaaagctttgaaactaagctggttcaagaaaggaagcaccatagggaaaatgtttgaggcaactgcccgaggagcacgaaggatggccatactgggagacaccgcatgggactttggttccataggaggagtgttcacatctgttggaaaactagtacaccagatttttggaactgcatatggagtcttgttcagcggcgtttcctggaccatgaaaataggaataggggttctgctgacatggctaggattaaactcaaggagcacgtccctttcgatgacgtgcattgcagttggcctggtaacactgtacttaggagtcatggttcaggcggactcgggatgtgtgatcaattggaaaggcagagaactcaaatgtggaagtggcatttttgtcaccaatgaagttcacacttggacagagcaatacaaatttcaggctgactccccaaaaagactatcagcagccatcgggaaggcatgggaggagggtgtgtgtggaattcgatcagccacccgtgtggagaacatcatgtggaagcaaatatcaaatgaactgaaccacatcttatttgaaaatgacatgaaattcacagtggtcgtaggagatgttagtgggattttggcccaaggaaaaaaaatgattaggccacaacccatggaacacaagtactcgtggaaaagctggggaaaagctaaaatcataggagcagatgtacagaactccaccttcatcattgacggcccaaacaccccagaatgccctgatgatcaaagagcatggaacatttgggaagttgaggactatggatttggaattttcacgacaaacatatggttgaaattgcgtgactcctacacccaagtgtgtgaccaccggctaatgtcagctgccatcaaggacagcaaggcagttcatgctgacatggggtactggatagaaagtgaaaagaacgagacttggaagctggcaagagcctccttcatagaagttaaaacatgcgtttggccaaaatcccacactctatggagcaatggagttctggaaagtgaaatgataattccgaagatatatggaggaccaatatctcagcacaactacagaccaggatatttcacacaaacggcagggccgtggcacttaggcaagttggaactagattttgatttgtgtgagggtaccacagttgtagtggatgaacattgtggaaatcgaggaccatctctaagaaccacaacagtcacaggaaaaataatccatgaatggtgctgcagatcttgtacgctaccacccttacgtttcaaaggagaagatgggtgttggtatggtatggaaattagaccagtcaaggaaaaggaagagaatctagttaaatcaatggtctctgcagggttaggagaagtggacagcttttcactaggactgctatgcatatcaataatgattgaagaggtgatgagatctagatggagtagaaaaatgctgatgactggaacactggctgtgttcctccttctcataatgggacaattgacatggaatgatctgatcaggttatgcatcatgattggagccaatgcctcagacaggatggggatgggaacaacgtacctagctctaatggccacttttaaaatgagaccaatgtttgctgtcgggctattgttccgcagactaacatccagagaagttcttcttcttacaattggattgagtctagtggcatccgtggagctaccaaattccttggaggagctgggggatggacttgcaatgggcattatgatcttaaaattactgactgactttcagtcacatcagctgtgggctgaattgctgtccctgacatttatcaaaacaacttgttctttgcactatgcatggaagacaatggctatggtactgtcaattgtgtctctcttccccttatgcatgtctacgacctctcaaaaaacaacatggcttccggtgctattgggatctcttggatgcaaaccactaactatgtttctcatagcagaaaacaaaatctggggaaggaaaagttggcctctcaatgaaggaatcatggctgttggaatagtcagcatcttactaagttcactcctcaagaatgatgtgccgctagctgggccactaatagctggaggcatgctaatagcatgttatgttatatctggaagctcagctgatttatcactagagaaagcggctgaggtttcctgggaagaagaagcagaacactctggtgcctcacacaatatattagtggaggtccaagatgatggaaccatgaagataaaagatgaagagagagatgacacactaaccattctccttaaagcaactctgctggcagtttcaggggtgtacccattatcaataccagcgaccctttttgtgtggtatttttggcagaaaaagaaacagagatcaggagtgttatgggacacacctagccctccagaagtggaaagagcggttcttgatgatggtatctatagaattatgcagagaggactgttgggcagatcccaagtaggggtaggagttttccaagaaaacgtgttccacacaatgtggcatgtcaccaggggagctgtactcatgtatcaagggaagagactggaaccgagttgggctagtgtcaaaaaagacctgatctcatatggaggaggttggaggcttcaaggatcctggaacacgggagaagaagtgcaggtgattgctgttgaaccagggaaaaaccccaaaaatgtacagacagcgccgggcaccttcaagacccctgaaggtgaagttggagccatagccctagattttaaacccggcacatctggatcccccatcgtgaacagagaggggaaaatagtaggtctttatggaaatggagtagtgacaacaagtggaacctacgtcagtgccatagctcaagctaaagcatcacaagaagggcccctaccagagattgaggacgaagtgtttaggaaaagaaacttaacaataatggacctacatccaggatcagggaaaacaagaagataccttccagccatagtccgtgaggccataaaaaggaagctgcgcacactaattttggctcccacaagagttgtcgcttccgaaatggcagaggcgctcaagggaatgccgataaggtatcagacaacagcagtgaagagtgaacacacaggaaaggagatagttgacctcatgtgccacgccactttcactatgcgtcttctgtctcccgtgagagttcccaactacaacatgattatcatggatgaagcacatttcaccgatccatccagtatagcagccagagggtacatctcaacccgagtgggcatgggtgaagcagctgcgatctttatgacagccactcccccaggatcagtggaggcctttccacagagcaatgcagttatccaagacgaggaaagagacattcctgagagatcatggaactcaggctatgactggatcactgacttcccaggtaaaacagtctggtttgttccaagcatcaaatcgggaaatgacattgccaactgtttaagaaagaatgggaaacgggtgattcaattgagtaggaaaacctttgacacagagtaccaaaagacaaaaaacaacgactgggactatgttgtcacaacagacatctccgaaatgggagctaacttccgagccgacagggtaatagacccaagacggtgtctgaaaccggtaatactaaaagatggtccagagcgtgtcattctagcaggaccgatgccagtgactgtggccagtgccgcccagaggagaggaagaatcggaaggaaccaaaataaggaaggtgatcagtacatctacatgggacagcctttaaacaacgatgaagaccacgctcattggacagaagcaaaaatgctccttgataatataaacacaccagaagggattatcccagccctctttgaaccggagagagaaaaaagtgcggcaatagacggggaatatagactgcggggtgaagcaaggaaaacgtttgtggagctcatgagaagaggggatctacctgtctggctatcctacaaagttgcctcagaaggcttccagtactctgacagaagatggtgctttgatggggaaaggaacaatcaggtgttggaggagaacatggacgtggagatctggacaaaagaaggagaaagaaagaaactacgaccccgctggctagatgccagaacatactcagacccattggccctgcgcgagtttaaagagtttgcagcaggaagaagaagcgtctcaggtgatctaatattagaaataggaaaacttccacagcacttgacgcaaagggcccagaatgccttggacaacctggtcatgttgcacaactccgaacaaggaggaagagcctacagacatgcaatggaagaactcccagacaccatagaaacgttaatgctcctagctttgatagctgtgttaactggtggagtgacgctgttcttcctatcaggaaggggcttagggaaaacatctatcggcctactttgcgtgatggcttcaagcgtgctgttatggatggccagtgtggagccccattggatagcggcctccatcatactggagttcttcctgatggtgctgcttattccagagccagacagacaacgcactccacaggacaaccagttggcatatgtagtgataggtttgttattcatgatactgacagtagcagccaatgagatgggattactggaaaccacaaagaaagacttagggattggccatgtggctgttgaaaatcaccaccatgccacaatgctagacgtagacttacatccagcttcagcctggaccctctatgcagtggccacaacaattatcacccctatgatgaggcacacaatcgaaaacacaacggcaaatatttccctgacagctattgcaaaccaggcagccatattgatgggacttgacaaaggatggccaatatcgaagatggatataggagttccacttctcgccttggggtgctattcccaggtgaatccactgacgctgacagcggcagtattgatgctagtggctcattacgccataattggacctggactgcaagcaaaagctactagagaagcccaaaaaaggacagcggccggaataatgaagaatccaactgtcgatggaatagttgcaatagatttggaccctgtggtttatgatgcaaaatttgagaaacaactaggccaaataatgttgttgatactgtgcacatcacagatcctcttgatgcggactacatgggccctgtgtgaatccatcacactggctactggacctctgaccacgctttgggagggatctccaggaaaattttggaacaccacgatagccgtgtccatggcaaacatattcagaggaagttatctagcaggagcaggcttggccttctcactaatgaaatctctaggaggaggtaggagaggtacgggagcccaaggggaaacattgggagaaaaatggaaaagacagctaaaccaactgagcaagtcagaattcaacacttacaaaaggagtgggatcatagaagtggatagatccgaagccaaagagggactgaaaagaggagaaacaaccaaacatgcagtgtcgagaggaaccgccaaactgaggtggtttgtggagaggaaccttgtgaaaccagaagggaaagtcatagaccttggttgtggaagaggtggctggtcatattattgcgccgggctgaagaaagtcacagaagtgaagggatacacaaaaggaggagctggacacgaggaaccaatcccaatggcgacctatggatggaacctagtaaagctacactccgggaaggacgtattctttacaccacctgaaaaatgtgacacccttttgtgtgacattggtgagtcctctccgaacccaaccatagaagaaggaagaacgttacgtgtcctaaagatggtggaaccatggctccgaggaaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagatgtggacttaggcgctggaacaagacatgtgacagtggaaccagaggtagctaacctagatatcattggccagaggatagagaatataaaacatgaacacaagtcaacatggcattatgatgaggacaatccatacaagacatgggcctatcatggatcatatgaggtcaagccatcaggatcagcctcatccatggtcaatggcgtggtgagactgctcaccaaaccatgggatgtcattcccatggtcacacaaatagccatgactgacaccacaccctttggacaacagagggtgtttaaagagaaagttgacacgcgcacaccaaaagcaaaacgaggcacagcacaagtcatggaggtgacagctaggtggttatggggttttctttctagaaacaaaaaaccaagaatctgcacaagagaggagttcacaagaaaagttaggtcaaacgcagccattggagcagtgttcgttgatgaaaatcaatggaattctgcaaaagaagcagtggaagatgagcggttttgggaccttgtgcacagagagagggagcttcacaaacagggaaaatgtgccagatgtgtttacaatatgatggggaaaagagagaaaaaactaggagagttcggaaaggcaaaaggaagtcgtgcaatatggtacatgtggttgggagcacgctttctagagtttgaagcccttggtttcatgaacgaagatcactggttcagtagagagaattcactcagtggagtagaaggagaaggactccacagactcggatacatactcagaggcatatcaaagattccagggggaaacatgtatgcagatgacacagccggatgggatacaaggatatcagaggatgatcttcagaatgaagccaaaatcactgacatcatggagcccgaacatgccttgctagctacgtcaatcttcaagctgacctaccaaaataaggtggtgagggtgcagagaccagcaaaaaatggaaccgtgatggatgttatatccagacgtgaccagagaggaagtggccaggtcggaacttatggcttaaacactttcaccaacatggaggcccagctaataagacaaatggagtctgagggaatcttttcacccagcgaattagagaccccaaatttggcccagagagttctcaactggttggaaaaatatggcgtcgaaaggctgaaaagaatggcaatcagcggagatgactgcgttgtgaaaccaattgatgacaggttcgcaacagccctaacagctctgaacgatatgggaaaagtgaggaaagacataccacaatgggaaccttcaaaaggatggaatgactggcaacaagtgcctttttgttcacaccatttccaccagctgattatgaaggatgggagggaaatagtggtgccatgccgcaaccaagatgaacttgtgggtagggctagagtgtcacaaggtgccgaatggagcctgagagaaactgcatgcctgggcaagtcatatgcacaaatgtggcagctgatgtacttccacaggagagacctgagactagctgctaatgccatctgttcagccgttccagttgattgggtcccaaccagccgcaccacttggtcgatccatgcccatcatcaatggatgacaacagaaaacatgttgtcagtgtggaatagggtttggatagaggaaaacccatggatggaggacaaaacccatgtgtccagttgggaagatgttccatatttagggaaaagggaagatcagtggtgtggttccctgataggcttaacagcaagggccacctgggccactaacatacaagtggccataaaccaagtgagaaggctaattgggaatgagaattatctagattatatgacatcaatgaagagatttaagaacgatagcgatcccgaaggggcactctggtga

SEQ ID NO: 48 - DNA, 10179 bp, Dengue virus
atgaacaaccaacgaaaaaagacgggtcgaccgtctttcaatatgctgaaacgcgcgagaaaccgcgtgtcaactggttcacagttggcgaagagattctcaaaaggattgctctcaggccaaggacccatgaaattggtgatggcttttatagcattcctaagatttctagccatacccccaacagcaggaattttggctagatggagttcattcaagaagaatggagcgatcaaagtgttacggggtttcaaaaaagagatctcaagcatgctgaacataatgaataggaggaaaagatccgtgaccatgctccttatgctgctgcccacagccttggcattccacttgaccacacgaggaggagagccacacatgatagttagcaagcaagaaaggggaaagtcacttttgttcaagacctctgcaggtgtcaacatgtgcaccctcattgcgatggacttgggagagttgtgtgaggacacaatgacctacaaatgccctcggatcactgaggcagaaccacatgacgttgactgctggtgcaatgccacagacacatgggtgacttacggaacatgttctcaaactggcgaacaccgacgagacaaacgctccgtagcactggctccacatgtggggcttggtctagaaacaagaaccgagacgtggatgtcctctgaaggcgcctggaaacaaatacaaaaagtggagacttgggccttgagacacccaggatttacggtgatagccctttttctagcacacgctataggaacatccattactcagaaagggattattttcatcctgctgatgctggtaacaccatcaatggccatgcgatgcgtgggaataggcaacagagacttcgttgaaggactgtcaggagcaacgtgggtggatgtggtactggagcatggaagctgcgtcaccaccatggcgaagaacaaaccaacattggacattgaacttctgaagacggaagttacgaaccctgccgtcttgcgcaaactgtgcattgaagcaaaaatatcaaacaccaccactgattcaagatgtccaacacaaggagaagccacattggtggaagaacaagacgcgaacttcgtgtgtcgacgaacgttcgtggacagaggctggggtaatggctgtggactattcggaaaaggaagcctattgacgtgtgctaagttcaagtgtgtgacaaaactagaagggaagatagttcaatatgaaaacctaaaatattcagtgatagtcaccgtccacactggggaccagcaccaggtgggaaatgagaccacagaacatggaacaattgcaaccataacacctcaagctcctacatcggaaatacagctgaccgactacggagccctcacattggactgctcacctagaacggggctggactttaacgagatggtgctgttgacaatgaaagaaaaatcgtggcttgtccataaacaatggtttctagacttaccactgccttggacctcgggggcttcaacatctcaagagacctggaacagacaagatttgctggttacatttaagacagcccatgcaaagaagcaggaagtagtcgtactgggatcacaagaaggagcaatgcacactgcgttgactggggcgacagaaattcagacgtcaggaacgacaacaatctttgcaggacatctgaaatgcagactaaaaatggataaactaactttaaaagggatgtcatatgtgatgtgtacaggctcatttaagttagagaaggaagtggctgagacccagcatggaaccgttttagtgcaggttaaatacgaaggaacagatgcaccatgcaagatccccttttcgatccaagatgagaaaggagtgacccagaatgggagattgataacagccaatcccatagttactgataaagaaaaaccagtcaacattgagacagaaccaccttttggtgagagctatatcgtggtaggggcaggtgaaaaaactttaaaactaagctggttcaaaaaaggaagcagcatagggaaaatgttcgaagcaaccgcccgaggagcacgaaggatggccatcttgggagacaccgcatgggacttcggttctataggaggagtgttcacgtctgtgggaaaactggtacaccaggtttttggaaccgcatacggggttttgttcagcggtgtttcttggaccatgaaaataggaatagggatcctgctgacatggctaggattaaattcaaggagcgcgtcactttcgatgacgtgcattgcagttggcatggtcacactatacctaggagtcatggttcaagcggactcgggatgtgtaatcaactggaagggcagagaactcaaatgtggaagtggcatttttgtcactaatgaagttcacacttggacagagcaatataaattccaggctgactccccaaaaagactgtcagctgccattgggaaggcatgggaggagggtgtgtgtggaatacgatcagccacacgtcttgagaacgtcatgtggaagcaaatatcaaatgaattgaaccatattttacttgaaaatgacatgaaattcacagtggttgtaggagatgttaatggaatcttggcccaaggaaaaaaaatgattaggccacaacccatggaacacaaatactcatggaaaagttggggaaaagccaaaatcataggagcagacacacagaataccacctttatcatcgacggcccagacactccagaatgccccgatgaccaaagagcatggaacatttgggaagttgaggactatggatttggaatcttcacgacaaacatatggctgaaattgcgtgattcctacacccaaatgtgtgaccaccggctaatgtcagctgccatcaaggacagtaaggcagtccatgctgacatggggtactggatagaaagtgaaaagaacgagacctggaagctagcgagagcctccttcatagaagtcaagacatgcatctggccaaaatcccacactctgtggagtaatggagttttggaaagtgaaatgataattccaaagatatatggaggaccaacatctcagcacaactacagaccagggtatttcacacaaacagcagggccatggcacctaggtaagttggaactagattttgatttgtgcgaaggcaccacagtagttgtggatgaacattgtggaaatcgaggtccatctctcagaactacaacagtcacaggaaagataatccatgaatggtgttgtagatcctgcacgttaccccccttacgctttaaaggggaagacggatgttggtatggcatggaaatcaggccagtcaaagagaaggaagagaacctagtcaggtcaatggtctctgcagggtcaggagaagtggacagtttttcattgggactactatgtgtatcaataatgattgaggaagtgatgagatccagatggagtagaaagatgctgatgactggaacactggctgttttccttcttcttataatgggacaattgacatggaatgatctgattagattatgcatcatggttggagctaatgcttcagacaggatgggcatgggaacaacgtacctagccttgatggccaccttcaaaatgagaccaatgtttgctgttgggctattatttcgcagattaacatccagagaagtacttctcctcacaattggattaagcctggtggcatccgtggagctaccaaattctctagaggagctaggggatggacttgcaatgggcatcatgatgttaaaattactgactgattttcaatctcatcagctatggacaaccttactgtctctgacattcgtccaaacaaccctttcattggattatgcatggaagacaatggccatggtgttgtcaatcgtatctctctttcctttatgtttgtccacgacctctcaaaaaacaacatggcttccggtgctgttaggatcttttggatgcaaaccattaaccatgttcctcataacagaaaataaaatctggggaaggaaaagttggcccctcaacgaaggaattatggcagttggaatagttagcattctactaagttcactcctaaaaaatgatgtgccattggctggcccactaatagctggaggcatgctaatagcatgttatgtcatatctggaagctcagccgatttatctctggagagagcagctgaggtctcctgggaagaagaagcggaacactctggtgcctctcacaacatcttagtggaggtccaagatgatggaaccatgaaaataaaagatgaagagagagatgacacactcaccatactccttaaagcaactctgctggcagtctcaggggtgtacccaatgtcaataccagcaaccctttttgtgtggtatttttggcagaaaaagaaacagagatcaggagtgttatgggacacacccagccctccagaagcggaaaaagcagttcttgatgatggtatttatagaattttgcaaagaggactgttgggcaggtctcaagtaggagtgggagtttttcaagatggcgtgttccacacaatgtggcacgtcactagaggggctgtcctcatgtaccaagggaagaggctggagccaagctgggctagtgtcaaaaaagacctgatctcatatggaggaggttggaggtttcaaggatcatggaacacgggagaagaagtgcaggtgatagctgttgaaccagggaaaaaccccaaaaatgtacagacaacaccaggtaccttcaagactcctgaaggcgaagttggagccatagccctagactttaaacccggcacgtctggatctcccatcgtgaacagagagggtaaaatagtaggtctctatggaaatggagtggtgacaacaagtggaacctacgttagtgccatagcccaagccaaagcgtcacaagaagggcctttaccagagattgaagacgaggtgtttaggaaaagaaacttaacaataatggacctacatccaggatcaggaaaaacaagaagataccttccagccatagttcgagaggccataaaaaggaaactgcgcacactaatcttggcacccacaagagttgtcgcctctgaaatggcggaggcgctcaagggaatgccaataagatatcagacaacagcagtgaaaagtgaacacacaggaagggagatagtagacctcatgtgccacgccactttcaccatgcgtctcctatctccagtgagagttcccaattacaacatgattatcatggatgaagcacattttaccgacccagccagcatagcggccagagggtacatctcaacccgagtgggtatgggtgaagcagctgcgatctttatgacagccactcctccaggatcggtggaggcctttccacagagcaatgcagtcatccaagatgaggaaagagacattcctgagagatcatggaactcaggctacgattggatcaccgatttcccaggtaaaacagtctggtttgttccaagcatcaaatcaggaaatgatattgccaactgcttaagaaagaacgggaaacgggtgatccaattgagcaggaaaacctttgacactgagtaccagaaaacaaaaaacaatgattgggactatgttgtcacaacagacatttctgaaatgggagcgaatttccgggctgacagggtaatagacccaaggcggtgcttgaaaccggtaatactaaaagatggtccagagcgcgttattctagccggaccgatgccggtgaccgtggccagtgctgcccagaggagaggaagaattggaaggaaccaaaacaaggaaggtgatcaatatgtttacatgggacagcctttaaacaacgatgaggaccatgctcattggacagaagcaaaaatgctccttgacaacataaacacaccagaaggaattatcccagctctctttgagccggagagagaaaagagtgcagcaatagacggggagtacagactgcggggagaagcaaggaaaacgttcgtggagctcatgagaagaggagatttaccagtttggctatcttacaaagttgcctcagaaggcttccaatactccgatagaaggtggtgctttgatggagaaaggaacaaccaggtgttggaggaaaacatggacgtggagatctggacaaaggagggagaaagaaagaaattacgaccccgctggttggacgccagaacatactctgatccactggccctgcgcgagttcaaagagttcgcagcaggaagaagaagtgtctcaggcgacctaatattagaaatagggaaacttccacaacatttgacattaaaggcccagaatgctctggacaacttggtcatgttgcacaattccgaacaaggaggaaaagcctataaacatgccatggaagaactaccagacaccatagaaacattgatgctcttagccttgatagctgtgctaactggtggagtgacgctgttcttcttatcaggaaaaggtctagggaaaacatccattggcctactctgtgtgatggcctcaagcatactgttatggatggccagtgtggagccccattggatagcggcctccatcatattagagttttttctgatggtgctgctcattccagagccagacagacagcgcactccacaggacaaccagctagcatatgtggtgataggcttgctattcatgatattgacagtggcagccaatgagatgggattactggaaaccacaaagaaagacctggggattggccaagtggctgccgaaaaccaccaccatgctacaatgctggacgtggacctacgtccagcttcagcctggaccctctatgcagtggccacaacaattatcactcccatgatgagacacacaattgaaaatacaacggcaaatatttccctgacagctattgcaaaccaggcagccatattgatgggacttgacaagggatggccgatatcgaagatggatataggggttccacttctcgccttaggatgctattctcaggtgaacccattaacactgacagcggcaatgttgatgctagtggctcactatgccataattggacctggattgcaagcaaaagccactagagaagctcaaaaaaggacagcggctggaataatgaaaaatccaaccgtagacggaattgtcgcaatagatttggatcctgtggtttacgatgcaaagtttgaaaaacagctaggccaaataatgttgctgatactttgcacatcacagattctcttaatgcggaccacatgggccttgtgcgaatccatcacactggctactggacccttgaccactctctgggagggatctccaggaaaattctggaacaccacgatagcagtgtccatggcaaacatcttcagaggaagttatctagcaggagcaggtctggccttttcattaatgaaatctttaggaggaggtaggagaggtacaggggctcaaggggaaacgctaggagaaaaatggaaaagacagctgaaccaactgagtaagtcagaattcaatacttacaagaggagcggaattattgaggtggacagatctgaagccaaggagggactgaagagaggagaaacaaccaaacatgcagtgtcgagaggaacagccaaactgaggtggtttgtggagagaaacctcgtgaaaccagaaggaaaagtcatagacctcggttgtggaagaggtggctggtcatattattgtgctgggttgaagaaagttacagaagtgaagggatacacaaaaggaggacctggacatgaggaacccatcccaatggcgacctatggatggaacctagtaaagctacactccggaaaagatgtattctttacaccacctgagaaatgtgacaccctcttgtgtgatattggtgagtcctctccgaatccaaccatagaagaaggaagaacgttgcgtgttctaaagatggtggaaccatggctcagaggaaaccaattttgcataaaaattctaaatccttacatgccaagtgtggtagaaactctggagcaaatgcaaagaaaacacggaggaatgttagtgcggaacccactatcaagaaattccacccatgaaatgtactgggtctcatgtggaacaggaaacattgtgtcggcagtgaacatgacatccagaatgttgctgaatcgattcacaatggctcacaggaagccaacatatgaaagagatgtggacttaggcgctggaacaagacatgtggcagtggaaccagaggtagccaacctagatatcattggccagaggatagagaacataaaaaatgaacacaagtcaacatggcattatgatgaagacaatccatacaaaacatgggcctatcatggatcatatgaggttaagccatcaggatcagcctcatcaatggtgaatggcgtagtaagactgctcactaaaccatgggatgtcatccccatggtcacacaaatagctatgactgacaccacacctttcggacaacagagggtgtttaaagagaaagttgatacgcgcacaccaagagcaaagcgaggcacagcacagattatggaggtaacagccaagtggttatggggtttcctttctagaaacaaaaaacccagaatctgcacaagagaggagttcacaaggaaggttaggtcaaacgcagcaatcggagcagtgttcgttgatgagaaccaatggaactcagcaaaagaggcagtggaagacgaaaggttttgggatctcgtgcacagagagagggagctccacaagcagggaaagtgtgccacgtgtgtctataatatgatggggaagagagagaaaaaattaggagagtttggaaaggcaaaaggaagtcgtgcaatatggtacatgtggttgggagcacgctttctagagttcgaagctcttggcttcatgaatgaagatcactggttcagtagagagaattcactcagtggagtggaaggagaaggactacacaaacttggatacatactcagagacatatcaaagattccagggggaaacatatatgcagatgacacagccggatgggacacgagaataacagaggacgatcttcaaaatgaggctaaaatcactgacattatggagcccgaacatgctctattggcttcatcaatctttaagctgacctatcaaaataaggtggtaagggtgcaaagaccagcaaaaagtggaaccgtgatggatgttatatccagacgtgaccagagaggaagtggacaggtcggaacttatggcttaaatactttcaccaacatagaggtccaactaataagacaaatggagtctgagggaatctttttacccagcgaattggaaacccccaatttagctgggagagctctcgactggttggaaaaacatggcgtcgaaaggctgaaaagaatggcaatcagtggagatgactgtgtggtgaaaccaactgatgataggttcgcaacagccttaacagctctgaatgacatgggaaaagtaagaaaagacataccacaatgggaaccttcaaaaggttggaatgattggcagcaagtgcctttctgttcacaccacttccaccagctgatcatgaaggatgggagggagatagtggtgccatgccgcaaccaagatgaactcgtgggcagggccagagtatcacaaggcgccggatggagtttgagagaaactgcttgcctaggcaagtcatatgcacaaatgtggcagctgatgtatttccacaggagagacctaagactggcggccaatgccatctgttcagccgttccagttgattgggttccaaccagtcgcaccacctggtcgatccatgcccaccaccaatggatgacaacagaagacatgttatcagtgtggaatagggtttggatagaggagaatccatggatggaggacaaaactcatgtatccagttgggaagacgttccatacttagggaaaagagaagatcagtggtgtggatccctgataggcttgacagctagggccacctgggccaccaacatacaagtagccataaaccaagtgagaaggctcatcggaaatgagaattatctagattacatgatatcaatgaagagattcaagaatgagagtgatcctgaaggggcactctggtaa

SEQ ID NO: 49 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggccttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcagaaccagatgacgttgattgttggtgcaataccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaacggctgtgggctcttcggaaaaggaagcctaataacgtgtgctaagttcaagtgtgtgacaaaactggaaggaaagatagtacaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattggtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacttaggagtcatggttcaggcggattcaggatgtgtaattaattggagaggtagagaactcaaatgtggaagtggcatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggattttggctcaagggaaaaagatgattaggccacaacccatggaatacaaatactcgtggaaaagctggggaaaggctaaaatcataggggcagatgtacagaacgccaccttcatcatcgacggcccaaacaccccagaatgccctgatgaccaaagagcatggaacatttgggaagttgaggactatggatttggaattttcacgacaaacatatggctgaaattgcgtgactcctacacccaagtgtgtgaccaccgactaatgtcagctgccatcaaggacagcaaggcagttcacgctgacatgggatactggatagaaagtgaaaagaacgagacctggaagctggcaagagcctctttcatagaagttaaaacatgtgtctggccaaaatcccacactctatggagcaatggagtcctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaacctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctattattccgcagactaacatccagagaagttcttcttctaacaattggactgagtctagtggcatctgtggagttaccaaattccttggaggagctgggggatggacttgcaatgggcattatgattttaaaattattgactgactttcaatcacatcagctgtgggctaccttgctgtccttgacattcatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggccgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaagcagagatctggagtgttatgggacacacctagccctccagaagtggaaagagcagttcttgacgatggtatttatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacagacagcgccaggcacctttaagacccctgaaggtgaagttggagctattgccctagatttcaaacccggcacatctggatctcccatcgtgaacagagaaggaaaaatagtaggtctttatggaaatggagtagtgacaacaagtggaacctacgtcagcgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaatcctggctcccacaagggttgtcgcttccgaaacggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatggaaaacgggtgattcaattgagcaggaaaacctttgatacagagtaccaaaaaacaaaaaataacgactgggactatgtcgtcacaacagacatctccgaaatgggagcaaatttccgggccgacagggtgatagacccaagacggtgtctgaaaccggtaatactaaaagatggtccagagcgtgttattttagcaggaccgatgccagtgactgtggccagtgccgcccagaggagaggaagaatcggaaggaaccacaataaggaaggtgatcagtacatctacatgggacagcctgtaaacaacgatgaagatcacgctcactggacggaagcaaaaatgctccttgataatacaaacacaccagaagggattatcccagccctcttcgagccggagagagaaaagagtgcagcaatagacggggaatacagactgcggggtgaagcaaggaaaacttttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaattacgaccccgctggctggatgccagaacatactcagacccactggccctgcgcgagtttaaagagtttgcagcaggaagaagaagcgtctcaggtgatctaatattagaaatagggaaacttccacaacatttgacgcaaagggcccagaatgccttggacaacctggttatgttgcacaactccgaacaaggaggaagagcctatagacatgcactggaagaactgccagacaccatagaaacgttgatgctcctagctttgatagctgtgttaactggtggagtgacgctgttcttcttatcaggaaggggcctagggaaaacatctattggcctactctgcgtgatggcttcaagcgtactgctatggatggccagtgtggagccccattggatagcggcctccatcatactggagttcttcctgatggtgctgctcattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgcctcaatgctggacgtagacttacacccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatgggtggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggcttagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgttaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctctctagaaacaagaaaccaagaatttgtacaagagaggagttcacaagaaaagttaggtcaaacgcagccattggagcagtgttcgttgatgaaaaccaatggaactcagcaaaagaagcagtggaagatgagcggttctgggaccttgtgcacagagagagggagcttcacaaacagggaaaatgtgccacgtgtgtttacaacatgatggggaagagagagaaaaaactcggagagttcggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaagtcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccaagagagttctcgactggttggaaaaatatggcgtcgaaaggctgaaaagaatggcaatcagcggagatgactgcgtggtgaaaccaactgatgacaggttcgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacttgagactagctgctaatgctatctgttcagccgttccagttgattgggtcccaaccagccgcaccacctggtcgatccatgcccaccaccaatggatgacaacagaagacatgctgtcagtgtggaatagggtttggatagaggaaaacccatggatggaggacaaaacccatatatccagttgggaagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 50 - DNA, 9930 bp, Dengue virus
atgaacaaccaacgaaaaaagacgggtcgaccgtctttcaatatgctgaaacgcgcgagaaaccgcgtgtcaactgtttcacagttggcgaagagattctcaaaaggattgctgtcaggccaaggacccatgaaattggtgatggcttttatagcattcctaagatttctagccatacctccaacagcaggaattttgcctagatggggctcattcaagaagaatggagcgattaaagtgttacggggtttcaaaaaagaaatctcaaacatgttgaacataatgaacaggaggaaaagatctgtgaccatgctcctcatgctgctgcccacagccatgacgttccatctgaccacccgagggcgagagccgctcatgatagttagcaagcaggaaagaggaaagtcacttttgttaaagacctctgcaggtgtcaacatgtgtacccttattgcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagtagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaacgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggaacttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagtcactgacaaagaaaaaccagtcaacattgaggcagaaccgccttttggtgagagttacatcgtgataggagcaggtgaaaaagttttgaaactaagctggttcaagaaaggaagcagcatagggaaaatgtttgaggcaactgccagaggagcacgaaggatggccatactgggagacaccgcatgggactttggttctatagggggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaaaaaaatgattaggccacaacccatggaatacaaatactcgtggaaaagctggggaaaggctaaaatcataggggcagatgttcagaacaccaccttcatcatcgacggcccaaacaccccagaatgccctgatgaccaaagagcatggaacatttgggaagttgaggactatggatttggaatcttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgttcgctgtagggctattattccgcagactaacatccagagaagttcctcttctaacaattggattgagtctagtggcatctgtggagttaccaaattccttggaggagctgggggatggacttgcaatgggcatcatgattttaaaattattgactgactttcaatcacatcagttgtgggctaccttgctgtccttgacatttatcaaaacaacgttttccttgcactatgcatggaagacaatagctatggtactgtcaattgtatctctcttccccttatgcctgtccacgacctcccaaaaaacaacatggcttccggtgctgttgggatctcttggatgcaaaccactaaccatgtttcttatagcagaaaacaaaatctggggaaggaaaagttggcccctcaacgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttgaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggattgttgggcaggtcccaagtaggggtaggagtttttcaagaaaacgtgttccacacaatgtggcatgtcaccaggggagctgtactcatgtaccaaggaaagagactggaaccaagctgggccagtgtccaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacgagaagatatcttccagccatagttcgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttaccgatccatctagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgactttccaggtaaaacagtttggtttgttccaagcatcaaatcaggaaatgacattgccaactgtttaagaaagaatgggaaacgggtgatccaattgagcagaaaaacttttgacactgagtaccagaaaacgaaaaataacgactgggactatgttgtcacaacagacatatcccaaatgggagcaaactttcgagccgacagggtaatagacccaaggcggtgcctgaaaccggtaatactgaaagatggtccagagcgtgtcattctagccggaccgatgccagtgactgtggctagtgccgcccagaggagaggaagatttggtaggaaccaaaataaggaaggtgatcagtatgtttacatgggacagcctctaaataatgatgaggaccacgcccattggacagaagcaaaaatgctccttgacaacataaacacaccagaagggatcatcccagccctctttgagccggaaagagaaaaaagtgctgcaatagacggggaatgcagactacggggtgaagcgaggaaaacgtttgtggagctcatgagaagaggagatctacctgtctggctatcttacaaagttgcctcagaaggcttccaatactccgacagaaggtggtgctttgatggggaaaggaacaaccgggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagagataggggaacttccacaacatttaacgcaaagggcccagaatgctttggacaatctggttatgctgcacaactctgaacaaggaggaaaagcttatggacacgccatggaagaattgccagacaccatagagacgttaatgctcctagctttgacagctgtgctgactggtggagtgacactattcttcctatcaggaagaggcctagggaaaacatccatcggcctactctgcgtgatggcttcaagcgtactgctatggatggccagtgtggagccccattggatagcggcctccatcatactggagttcctcctgatggtgctgcttattccagagccagacagacaacgcactccgcaggacaaccagctggcatatgtggtgataggtttgttattcatgatactggcagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttctctgacagccattgcaaaccaggcagctatattgatgggacttgacaaaggatggccaatatcgaagatggacataggagttccacttctcgtcttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctcccggaaaattttggaacaccacgatagcggtttccatggcaaacattttcagaggaagttatctagcaggagcaggtctggccttctcattaatgaaatctctaggaggaggtaggagaggcacgggagccaaggggaaacactgggagagaaatggaaaagacagactgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaagggaggacctggacatgaggaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaatcaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgatatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgtttaaagagaaagttgacacacgtacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttgggtatatactcagagacatatcaaagattccagggggaaacatgtatgcagatgacacagccggatgggatacaaggataacagaggatgaccttcagaacgaggccaaaattactgacatcatggaacccgaacatgccctattggccaagtcaatcttcaagctaacctaccaaaataaggtggtaagggtacagagaccagcaaaaaatggaaccgtgatggatgtcatatccagacgtgaccagagaggaagtggccaggtcggaacttatggcttaaacactttcaccaacatggaagctcagctgataagacaaatggagtctgagggaatcttttcacccagcgaattagagaccccaaatttagccgagagagttctcgactggctggaaagatatggcgtcgaaaggctgaaaagaatggcaatcagcggagatgactgcgtagtgaaaccaattgatgataggtttgcaacagccttaacagctctgaatgatatgggaaaagtaagaaaagatataccacaatgggaaccttcaaaaggatggaatgattggcaacaagtgtctttttgttcacaccacttccaccagctgattatgaaagatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacgacagaagacatgctgtcagtgtggaatagggtttggata

SEQ ID NO: 51 - DNA, 9930 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaactggtgatggcttttatagcattcctaagatttctagccatacctccaacagcaggaattttggctagatggggctcattcaagaagaatggagcgattaaagtgttacggggtttcaaaaaagaaatctcaaacatgttgaacataatgaacaggaggaaaagatctgtgaccatgctcctcatgctgctgcccacagccatgacgttccatctgaccacccgagggggagagccgcacatgatagttagcaagcaggaaagaggaaagtcacttttgtttaagacctctgcaggtgtcaacatgtgtacccttattgcgatggatttgggagagttatgtgatgacacgatgacctacaaatgcccccagatctctgagacggaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggatgtcctctgaaggcgcctggagacaaatacaaaaagtggagacatgggctctgagacacccaggattcacggtgatagccctttttctagcacatgctataggaacatccatcacccaaaaagggattattttcattttgttgatgctggtaacaccatccatggccatgcgatgcgtaggaataggcagcagggacttcgtggaaggactgtcaggagcaacttgggtagatgtgatactggaacatggaagttgcgtcaccatcatggcaaaagacaaaccaacattggacattgaactcttgaagacggaagtcacagaccctgccgtcctgcgcaaactgtgcattgaagccaaaatatcaaacaccaccaccgattcaagatgtccaacacaaggagaagccacactggtggaagaacaagacgcgaactttgtgtgtcgacgaacgtttgtggacagaggctggggcaatggctgtgggctcttcggaaaaggtagcttaataacgtgtgctaagtttaagtgtgtgacaaaattggaaggaaagatagtccaatatgaaaacttaaaatattcagtgatcgttaccgtccacactggagaccagcaccaagttggaaatgagaccacagaacatggaacaattgcaaccataacacctcaagctcccacgtcggaaatacaattgacagactacggagctctaacactggactgttcacctagaacagggctagactttaatgagatggtgttgttgacaatgaaagaaaaatcatggctcgtccacaaacaatggtttctagacttaccactgccttggacctcaggggcctcaacatcccaagagacttggaacagacaagacttgctggtcacatttaagacagctcatgcaaagaagcaggaagtagtcgtactaggatcacaagaaggagcaatgcacactgcgttgaccggagcgacagaaatccaaacgtctggaacgacaacaatttttgcaggccacctgaaatgcagactaataatggataaactgactttaaaaggaatatcatatgtaatgtgcacaggcccatttaagttagagaaggaagtggctgagacccagcatggaactgttctagtacaggttaaatacgaaggaacagatgcaccatgcaagatccccttttcgtcccaagatgagaagggagtaacccagaatgggagattggtaacagccaaccccatagtcactgacaaagaaaaaccagtcaacattgaggcggaaccaccttttggtgagagctacatcgtggtaggagcaggtgaaaaagccttgaaactaagctggttcaagaagggaagcagtatagggaaaatgtttgaagcaactgcccgtggagcccgaaggatggccatcctgggagacaccgcatgggacttcgggtctataggaggagtgttcacgtctgtgggaaaactggtacaccagatttttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtcaccaatgaagttcacacctggacagagcaatacaaattccaggccgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggttgtaggagatgttgttgggatcttggcccaagggaagaaaatgattaggccacaacccatggaacacaaatactcgtggaaaagctggggaaaagctaaaatcataggggcagatgtacagaacaccaccttcatcatcgacggcccaaacactccagaatgccctgatgatcaaagagcatggaacatctgggaagttgaggactatggatttggaattttcacgacaaacatatggttgaaattgcgtgactcttacacccaagtgtgtgaccaccggctaatgtcagctgccatcaaggacagcaaagcagtccatgctgacatggggtactggatagaaagtgaaaagaacgagacttggaagttggcaagagcctccttcatagaagtcaagacatgcatttggccaaaatctcacactctatggagcaatggagtcctggaaagtgagatgataatccccaagatatatggaggaccaatatctcagcacaattacagaccaggatatttcacacaaacagcagggccgtggcacttaggcaagttggaactagattttgatttgtgtgaaggtaccacagttgttgtggatgaacattgtggaaatcgaggaccatctcttagaaccacaacagtcacaggaaagataatccatgaatggtgctgtagatcttgcacgttaccacccctacgtttcaaaggagaagacgggtgctggtacggcatggaaatcagaccagtcaaggagaaggaagagaacctagttaagtcaatggtctctgcggggtcaggagaagtggacagtttttcactaggactgttatgcatatcaataatgatcgaagaggtaatgagatccagatggagcaggaaaatgctgatgactggaacattggctgtgttcctccttctcacaatgggacaattgacatggaacgacctgatcaggctatgcatcatggttggagccaatgcttcagataatatggggatgggaacaacgtacttagctttgatggccactttcagaatgagaccaatgttcgcagtcgggctattattccgcagactaacatctagagaagttcttcttctcacggttggattgagtctggtggcatctgtagaattaccaaattccttagaggagctaggggatggatttgcaatgggcatcatgatattaaaattactgactgattttcaatcacatcagctatgggccaccttgctgtctctaacatttgtcaaaacaactttttcattgcactatgcatggaagacaatggctatgatactgtcaatcgtatctctcttccctttatgcctgtccacgacttctcaaaaaacgacatggcttccggtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactggctggcccattaatagctggaggcatgctaatagcatgttatgtcatatccggaagctcggccgatttatcactggagaaagcggctgaggtctcctgggaagaagaagcagaacactctggcgcctcacacaatatactagtggaggtccaagatgatggaaccatgaagataaaggatgaagagagagatgacacgatcaccatcctcctcaaagcaaccctgctagcaatctcaggggtatatccaatgtcaataccggcgactctctttgtgtggtatttttggcagaaaaagaaacagagatcaggagtgctatgggacacacctagccctccagaagtggaaagagcagtccttgatgatggtatttatagaattctccaaagaggattgttgggcaggtctcaggtaggagtaggagttttccaagaaggcgtattccacacaatgtggcacgtcaccaggggagctgttctcatgtatcaagggaagagattggaaccaagttgggctagtgtcaaaaaagacttgatctcatatggaggaggttggaggtttcaaggatcctggaacacgggagaagaagtgcaggtgattgctgttgaaccggggaagaacccaaaaaatgtacagacagcgccgggtaccttcaagacctctgaaggcgaagttggagccatagctctagactttaaacccggcacatctggatctcctatcgtgaacagagagggaaaaatagtaggtctttatggaaatggagtggtgacaacaagtggaacctatgtcagtgctatagctcaagctaaagtatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttttggctcccacaagagttgtcgcctctgaaatggcagaggcgcttaagggaatgccaataaggtatcagacaacagcagtgaagagtgaacacacaggaaaagagatagttgacctcatgtgtcacgccactttcaccatgcgtctcctgtctcccgtgagagttcccaattacaacatgattatcatggatgaagcacatttcacagatccatctagcatagcggccagagggtacatctcaacccgagtgggcatgggtgaagctgctgcgatcttcatgacagccactcccccaggatcagtggaggcctttccacagagcaatgcagttatccaagatgaggaaagagacattcctgagagatcatggaactcaggctatgagtggatcactgacttcccaggtaaaacagtctggtttgttcccagcatcaaatcaggaaatgacattgccaactgtttaagaaagaatgggaaacgggtgatccaattgagcagaaaaacttttgacactgagtaccagaaaacgaaaaataacgactgggactatgttgtcacaacagacatatccgaaatgggagcaaactttcgagccgacagggtaatagacccaaggcggtgcctgaaaccggtaatactgaaagatggtccagagcgtgtcattctagccggaccgatgccagtgactgtggctagtgccgcccagaggagaggaagaattggaaggaaccaaaataaggaaggtgatcagtatgtttacatgggacagcctctaaataatgatgaggaccacgcccattggacagaagcaaaaatgctccttgacaacataaacacaccagaagggatcatcccagccctctttgagccggaaagagaaaaaagtgctgcaatagacggggaatacagactacggggtgaagcgaggaaaacgtttgtggagctcatgagaagaggagatctacctgtctggctatcttacaaagttgcctcagaaggcttccaatactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagagatagggaaacttccacaacatttaacgcaaagggcccagaatgctttggacaatctggttatgctgcacaactctgaacaaggaggaaaagcttatagacacgccatggaagaattgccagacaccatagagacgttaatgctcctagctttgatagctgtgctgactggtggagtgacactattcttcctatcaggaagaggcctagggaaaacatccatcggcctactctgcgtgatgtcctcaagtgcactgttgtggatggccagtgtggagccccattggatagcggcctctatcatactggagttctttctgatggtgttgcttattccagagccagacagacagcgcactccacaagacaaccagttagcatatgtggtgataggtttgctattcatgatattgacagtggcagcgaatgagatgggattattggaaaccacaaagaaagacctggggattggtcatgcagccgctgaaaaccaccaccacgccgcaatgctggacgtagacctacatccagcttcagcctggactctctatgcagtggccacaacgattatcactcccatgatgagacacacaattgaaaacacaacagcaaatatttccctgacagctattgcaaaccaggcagctatattgatgggacttgataagggatggccaatatcaaagatggatataggagttccacttctcgccttggggtgctattctcaggtgaacccgctaacgctgacagcggcggtactgatgctagtagctcattatgccataattggaccaggactgcaagcaaaagccactagagaagctcaaaaaaggacggcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacgatagcggtgcccatggcaaacattttcagggggagttatctagcaggagcgggtctggccttctcattaatgaaatctctaggaggaggtaggagagggacgggagccaaggggaaacactgggagaaaagtggaaaagacagactaaaccaattgagcaagtcagaattcaacacttacaagaggagtggtattatagaggtggatagatctgaagccaaggaggggttgaaaagaggagaaacaaccaaacacgcagtgtcgagaggaacggccaaactgaggtggtttgtggagaggaatcttgtgaaaccagaagggaaagtcatagacctcggttgtggaagaggtggctggtcatattattgcgctgggctgaagaaagtcacagaagtgaaaggatacacaaaaggaggacctggacatgaggaaccaatcccaatggcaacctatggatggaacctagtaaagctacactccgggaaagatgtgttctttataccacctgagaagtgtgacacccttttgtgtgatattggtgagtcctctccaaacccgactatagaagaaggaagaacgttacgtgttctaaagatggtagaaccatggctcagaggaaaccaattttgcataaaaattctaaacccctatatgccgagtgtggtagaaactctggagcaaatgcaaagaaaacatggaggaatgctagtgcgaaatccactctcaagaaactccactcatgaaatgtactgggtttcgtgtggaacaggaaacattgtgtcagcagtaaatatgacatctagaatgctgctaaatagattcacaatggctcacaggaagccaacatatgaaagagatgtggacttgggcgctggaacaagacatgtggcagtagaaccagaggtggccaacctagacatcattggccagaggatagagaatataaaaaatgaacacaaatcaacatggcactatgatgaggacaatccgtacaaaacatgggcctatcatggatcatatgaggtcaagccatcaggatcagcctcatccatggtcaatggtgtggtgagactgctaaccaaaccatgggatgttatccccatggtcacacaaatagccatgactgacaccacaccctttggacaacaaagggtgtttaaagagaaagttgacacgcgtacgccaaaagcgaaacgaggcacagcacaaatcatggaggtgacagccaggtggttatggggtttcctctctagaaacaaaaaacccagaatctgcacaagagaggagttcacaagaaaagtcaggtcaaatgcagctattggagcagtgttcgttgatgaaaatcaatggaactcagcaaaagaggcagtggaagatgaaaggttctgggaccttgtgcgcagagagagggagcttcataaacaagggaaatgtgccacgtgtgtctacaacatgatgggaaagagagagaaaaaattaggagagttcggaaaggcaaaaggaagtcgcgcaatatggtacatgtggttgggagcgcgcttcttagagtttgaagcccttggcttcatgaatgaagatcactggttcagcagagagaactcactcagtggagtggaaggagaaggactccacaaacttggatacatactcagagacatatcaaagattccagggggaaatatgtatgcagatgatacagccggatgggacacaagaataacagaggatgatcttcagaatgaggccaaaatcactgacatcatggaacctgaacatgccctactggccacgtcaatctttaagctaacctaccaaaacaaggttgtaagggtgcagagaccagcaaaaaatggaaccgtgatggatgtcatatccaggcgtgaccagagaggaagtggacaggttggaacttatggcttaaacaccttcaccaatatggaggcccaactaataagacaaatggagtctgagggaatcttttcacccagcgaattggaaaccccaaatttagccggaagagtccttgactggttggaaaaacatggcatcgagaggctgagaagaatggcaatcagtggagatgactgtgtggtgaaaccaattgatgacagatttgcgacagccttaacagccttgaatgacatgggaaaggtaagaaaggacataccgcaatgggagccttcaaaaggatggaatgattggcaacaagtgcctttctgctcacaccacttccaccagctgatcatgaaggatgggagggagatagtggtgccatgccgcaaccaagatgaactggtaggtagggccagagtatcacaaggcgccggatggagcttgagggaaactgcatgtctaggcaagtcgtatgcacaaatgtggcagctgatgtacttccacaggagagacttgagattagcggctaatgctatctgttcagccgttccagttgattgggtcccaaccagccgcaccacctggtcgatccacgcccaccatcaatggatgacaacagaagacatgttgtcagtgtggaatagggtttggata

SEQ ID NO: 52 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgattaaagtgttacagggtttcaagaaagaaatctcaaacatgttgaatataatgaatagaaggaagagatccgtgaccatgctccttatgctgctgcccacagccttggcgtttcatctgaccacacgagggggagagccgcatatgatagttaccaagcaggaaagaggaaagtcacttttgtttaagacctcagctggtgtcaacatgtgcacccttattgcgatggatttgggagagttatgtgaggacacaatgacttacaaatgccctcgaatcactgaggcggaaccagatgacgttgattgttggtgcaatgccacagacacatgggtgacctatggaacgtgttcccaaactggcgagcaccgacgagacaaacgttccgtcgcactggccccacacgtgggacttggtctagaaacaagaaccgaaacgtggatgtcctctgaaggcgcttggaaacaaatacaaagagtggagacttgggccctgagacatccaggattcacagtgatagccctttttctagcacatgccataggaacatccatcacccagaaagggattattttcatcttgttgatgctggtaacaccatccatggccatgcgatgtgtgggaataggcaacagggacttcgtggaaggactgtcaggagcaacgtgggtagatgtggtactggaacatggaagttgcgtcaccaccatggcaaaagataaaccaacattggacattgaactcttgaagacggaagtcacaaaccctgccgtcctgcgcaaactgtgcatcgaagctaaaatatcaaacaccaccaccgattcaagatgtccaacacaaggagaagccacactggtggaagaacaagacgcgaattttgtgtgtcgacgaacgtttgtggacagaggctggggcaatggctgtgggcttttcggaaaaggtagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaacagcaactataacacctcaagctcccacgtcggaaatacagctgaccgactacggagctcttacattggattgctcacctagaacaggactagacttcaatgaaatggtgttgttgacaatgaaagaaaaatcatggctagtccacaaacaatggtttctagacttaccactgccttggacctcgggagctacaacgtcacaagagacttggaacagacaagatttgccggtaacatttaagacagctcatgcaaagaagcaggaagtagtcgtactaggatcacaagaaggagcaatgcacactgcgttgaccggagcgacagaaatccaaacgtctggaacgacaaaaatttttgcaggacacttgaaatgtagactaaaaatggacaaactgactctaaaagggatgtcatatgtgatgtgcacaggctcattcaagctagagaaaggggtggctgagacccagcatggaaccgttctagtgcaggttaaatacgaaggaacagatgcaccatgcaagatccctttttcaacccaagatgaaaaaggagtaatccagaatgggagagtgataacagccaaccctatagtcactgacaaggaaaaaccagtcaacattgaggcagaaccaccttttggtgagagttacatcgtggtaggagcaggtgaaaaagctttgaaactaagctggttcgagaaaggaagcaccatagggaaaatgtttgaggcaactgcccgaggagcacgaaggatggccatactgggagacaccgcatgggactttggttctataggaggagtgttcacatctgtgggaaaattagtgcatcagatttttggaactgcatatggagttttgttcagcggtgtttcctggactatgaaaataggaataggggttctgctgacatggctaggattaaactcaaggagcacgtccctttcgatgacgtgcattgcagttggcctggtaacactgtacctaggagtcatggttcaggcggattcgggatgtgtaattaattggaaaggcagagaactcaaatgtggaagtggcatttttgtcaccaatgaagttcacacttggacagagcaatacaaatttcaggctgactccccaaagagactatcagcagccatcgggaaggcatgggaggagggtgtgtgtggaattcgatcagccactcgtctcgagaacatcatgtggaagcaaatatcaaatgaactgaaccacatcttacttgaaaatgacatgaaattcacagtggttgtaggagatgttagtgggatcttggcccaaggaaaaaaaatgattaggccacaacccatggagtacaaatactcgtggaaaagctggggaaaagctaaaatcataggggcagatgtacagaactccaccttcatcatcgacggcccaaacacccctgaatgccccgatgatcaaagagcatggaacatttgggaagttgaggactatggatttggaattttcacgacaaacatatggttgaaattgcgtgactcctacacccaagtgtgtgaccaccggctaatgtcagctgccatcaaggacagcaaggcagttcatgctgacatggggtactggatagaaagtgaaaagaacgagacttggaagctggcgagagcctccttcatagaagttaaaacatgcgtctggccaaaatcccacactctatggagcaatggagttctggaaagtgaaatgataattccaaagatatatggaggaccaatatctcagcacaactacagaccaggatatttcacacaaacagcagggccgtggcacttaggcaagttggaactagattttgatttgtgtgagggtaccacagttgttgtggatgaacattgtggaaatcgaggaccatctcttagaaccacaacagtcacaggaaaaataatccatgaatggtgctgcagatcttgtacgctaccacccttacgtttcaaaggagaagatgggtgttggtatggtatggaaattagaccagtcaaggaaaaggaagagaatctagtcaaatcaatggtctctgcagggtcaggagaagtggacagcttttcactaggactgctatgcatatcaataatgatcgaagaggtgatgagatctagatggagtagaaaaatgctgatgactggaacactggctgtgttcctccttctcataatgggacaattgacatggaatgatctgatcaggttatgcatcatggttggagccaatgcttcagacaggatggggatgggaacaacgtacctagctctgatggccactttcaaaatgagaccaatgtttgctgtcgggctgttgttccgcagactaacatctagagaagttcttcttcttacaattggattgagtctagtggcatccgtggagctaccaaattccttggaggagctgggggatggacttgcaatgggcattatgatcttaaaattactgactgactttcagtcacatcagctgtgggctgccttgctgtccctgacatttatcaaaacaactttttctttgcactatgcatggaagacaatggctatggtactgtcaattgtgtctctcttccccttatgcctgtccacgacctctcaaaaaacaacatggcttccggtgctattgggatctcttggatgcaaaccactaaccatgtttcttatagcagaaaacaaaatctggggaaggaaaagttggcctctcaatgaaggaatcatggctgttggaatcgtcagcatcttactaagttcactcctcaaaaatgatgtgccgctagctgggccactaatagctggaggcatgctgatagcatgttatgttatatctggaagctcagccgatttatcactagagaaagcggctgaggtctcctgggaagaagaagcagaacactctggtgcctcacacaatatattagtagaggtccaagatgatggaaccatgaagataaaagatgaagagagagatgatacactaaccattctccttaaagcaactctgctggcagtttcaggggtgtacccattatcaataccagcgaccctttttgtgtggtatttttggcagaaaaagaaacagagatcaggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtaccaagggaagaggctggaaccgagttgggctagtgtcaaaaaagacctgatctcatatggaggaggttggaggcttcaaggatcctggaacacgggagaagaagtgcaggtgattgctgttgaaccagggaaaaaccccaaaaatgtacagacagcgccgggcaccttcaagacccctgagggtgaggttggagccatagccctagattttaaacccggcacatctggatctcccatcgtgaacagagaggggaaaatagtaggtctttatggaaatggagtagtgacaacaagtggaacctacgtcagtgccatagctcaagctaaagcatcacaagaagggcccctaccagagattgaggacgaggtgtttaggaaaagaaacttaacaataatggacctacatccaggatcgggaaaaacaagaagatatcttccagccatagtccgtgaggccataaaaaggaagctgcgcacactaattttggctcccacaagagttgtcgcttccgaaatggcagaggcgctcaagggaatgccgataaggtatcagacaacagcagtgaagagtgaacacacgggaaaggagatagttgacctcatgtgccacgccactttcaccatgcgtctcctgtctcccgtgagagttcccaattacaacatgattatcatggatgaagcacatttcaccgatccatccagcatagcggccagagggtatatctcaacccgagtgggtatgggtgaagcagctgcgatcttcatgacagccactcccccaggatcagtggaggcctttccacagagcaatgcagttatccaagatgaggaaagagacattcctgagagatcatggaactcaggctatgactggatcactgatttcccaggtaaaacagtctggtttgttccaagcatcaaatcaggaaatgacattgccaactgtttaagaaagaatgggaaacgggtgattcaattgagcaggaaaacctttgatacagagtaccaaaagacaaaaaacaacgactgggactatgtcgtcacaacagacatctccgaaatgggagctaacttccgagccgacagggtaatagacccaagacggtgtctgaaaccggtaatactaaaagatggtccagagcgtgtcattctagcaggaccgatgccagtgactgtggccagtgccgcccagaggagaggaagaatcggaaggaaccaaaataaggaaggtgatcagtacatctacatgggacagcctttaaacaacgatgaagatcacgctcattggacagaagcaaaaatgctccttgataatataaacacaccagaagggattatcccagccctctttgaaccggagagaaaaaagagtgcggcaatagacggggaatatagactgcggggtgaagcaaggaaaacgtttgtggagctcatgagaagaggggatctacctgtctggctatcctacaaagttgcctcagaaggcttccagtactctgacagaagatggtgctttgatggggaaaggaacaatcaggtgttggaggagaacatggacgtggagatctggacaaaagaaggagaaagaaaggaactacgaccccgctggctggatgccagaacatactcagacccattggccctgcgcgagtttaaagagtttgcagcaggaagaagaagcgtctcaggtgatctaatattagaaatagggaaacttccacagcacttgacgcaaagggcccagaatgccttggacaacctggtcatgttgcacaactccgaacaaggaggaagagcctacagacatgcaatggaagaactcccagacaccatagaaacgttgatgctcctagctttgatagctgtgttaactggtggagtgacgctgttcttcctatcaggaaggggcttagggaaaacatctatcggcctactctgcgtgatggcttcaagcgtactgttatggatggccagtgtggagccccattggatagcggcctccatcatactggagttcttcctgatggtgctgcttattccagagccagacagacaacgcactccacaggacaaccagttggcatatgtagtgataggtttgttattcatgatactgacagtagcagccaatgagatgggattactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaatatttccctgacagctattgcaaaccaggcagctatattgatgggactcgacaaaggatggccaatatcgaagatggacataggagttccacttctcgccttggggtgctattcccaggtgaatccactgacgctgacagcggcagtattgatgctagtggctcattacgccataattggacctggactgcaagcaaaagctactagagaagctcaaaaaaggacagcggccggaataatgaagaatccaactgtcgatggaatagttgcaatagatttggaccctgtggtttatgatgcaaaatttgagaaacaactaggccaaataatgttgttgatactatgcacatcacagatcctcttgatgcggactacatgggccttgtgtgaatccatcacactggctaccggacctctgaccacgctttgggagggatctccaggaaaattttggaacaccacgatagccgtgtccatggcaaacatattcaggggaagttatctagcaggtgcaggcctggccttctcactaatgaaatctctaggaggaggtaggagaggtacgggagcccaaggggaaacactgggagaaaaatggaaaagacagctaaaccaactgagcaagtcagaatttaacacttacaaaaggagtgggattatggaagtggatagatccgaagccaaagagggactgaaaagaggagaaacaaccaaacatgcagtgtcgagaggaaccgccaaactgaggtggtttgtggagaggaaccttgtgaaaccagaagggaaagtcatagacctcggttgtggaagaggtggctggtcatattattgcgccgggctgaagaaagtcacagaagtgaagggatacacaaaaggaggagctggacatgaggaaccaatcccaatggcgacctatggatggaacctagtaaagctatactccgggaaagacgtattctttacaccacctgagaaatgtgacacccttttgtgtgacattggtgagtcctctccgaacccaaccatagaagaaggaagaacgttacgcgtcctaaagatggtggaaccgtggctccgaggaaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacttaggcgctggaacaagacatgtggcagtggaaccagaggtagccaacctagatgtcattggccagaggatagagaacataaaacatgaacataagtcaacatggcattatgatgaggacaatccatacaagacatgggcctatcatggatcatatgaggtcaagccaacaggatcagcctcatccatggtcaatggcgtggtgagactgctcaccaaaccatgggatgtcattcccatggtcacacaaatagccatgactgacaccacaccctttggacaacagagggtgtttaaagagaaagttgacacgcgcacaccaaaagcaaaacaaggcacagcacaaatcatggaggtgacagccaggtggttatggggttttctttctagaaacaaaaaaccaagaatctgtacaagagaggagttcacaagaaaagttaggtcaaacgcagctattggagcagtgttcgttgatgaaaatcaatggaactctgcaaaagaagcagtggaagatgagcggttttgggaccttgtgcacagagagagggagcttcacaaacagggaaaatgtgccacgtgtgtttacaatatgatggggaagagagagaaaaaactaggagagttcggaaaggcaaaaggaagtcgtgcaatatggtacatgtggttgggagcacgctttctagagtttgaagcccttggtttcatgaacgaagatcactggttcagtagagagaattcactcagtggagtggaaggagaaggactccacagactcggatatatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatctttaagctgacctaccaaaataaggtggtgagggtgcagagaccagcaaaaaatggaaccgtgatggatgttatatccagacgtgaccagagaggaagtggccaggtcggaacttatggcttaaacactttcaccaacatggaggcccagctaataagacaaatggagtctgagggaatcttttcacccagcgaattggagaccccaaatttggccgagagagttctcgactggttgaaaaaatatggcgtcgaaaggctgaaaagaatggcaatcagcggagatgactgcgtggtgaaaccaattgatgacaggttcgcaacagccctaacagctctgaacgatatgggaaaagtaagaaaagacataccacaatgggaaccttcaaaaggatggaatgattggcaacaagtgcctttttgttcacaccatttccaccagctgattatgaaggatgggagggaaatagtggtaccatgccgcaaccaagatgaacttgtgggtagggctagagtatcacaaggtgccggatggagcctgagagaaactgcatgcctgggcaagtcatatgcacaaatgtggcagctgatgtacttccacaggagagacctgagactagctgctaatgccatctgttcagccgttccagttgattgggtcccaaccagccgcaccacttggtcgatccatgcccatcatcaatggatgacaacagaagacatgttgtcagtgtggaatagggtttggatagaggaaaacccatggatggaggacaaaacccatgtatccagttgggaagatgttccatatttaggaaaaagggaagatcagtggtgtggatccctgataggcttaacagcaagggctacctgggccaccaacatacaagtggccataaaccaagtgagaagactaatcgggaatgagaattatctagattacatgacatcaatgaagagattcaagaacgagagtgatcccgaaggggcactctggtga

SEQ ID NO: 53 - DNA, 10191 bp, Dengue virus
atgaacaaccaacgaaaaaagacggctcgaccgtctttcaatatgctgaaacgcgcgagaaaccgcgtgtcaactggttcacagttggcgaagagattctcaaaaggattgctttcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaacataatgaatagaaggaaaagatctgtgaccatgctcctcatgctgctgcccacagccttggcgttccatttgactacacgagggggagagccacacatgatagttagcaagcaggaaagagaaaagtcactcttgtttaagacctctgtaggtgtcaacatgtgcacccttatagcgatggatttgggagagttatgtgaggacacaatgacttacaaatgccctcgaattactgaggcggaaccagatgacgttgattgttggtgcaatgctacagacacatgggtgacctatggaacatgttcccaaactggcgagcaccgacgggacaaacgttccgtcgcactggccccacacgtgggacttggtctagaaacaagaaccgaaacgtggatgtcctctgaaggcgcttggaaacaaatacaaagagtggagacttgggctttgcgacacccaggattcacggtgatagccctttttcttgcacatgccataggaacatccatcactcagaaagggattattttcattttgttaatgctagtaacaccatccatggccatgcgatgcgtgggaataggcagcagggacttcgtggaaggactatcaggagcaacttgggtagacgtggtactggaacatggaagttgcgtcaccaccatggcaaaagacaaaccaacattggacattgaactcctgaaaacggaggtcacgaaccctgccgtcctgcgcaaactgtgcattgaagctaaaatatcaaacaccaccaccgattcaagatgtccaacacaaggagaagctacactggtggaagaacaagacgcgaactttgtgtgtcgacgaacgttcgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaactgggctggactttaatgagatggtgctattgacaatgaaagaaaaatcatggcttgttcacaaacaatggtttctagacttaccactgccttggacttcgggggcttcaacatcccaagagacttggaacagacaagatttgctggtcacattcaagacagctcatgcaaagaagcaggaagtagtcgtactgggatcacaggaaggagcaatgcacactgcgttgactggggcgacagaaatccaaacgtctggaacgacaacaatttttgcaggacacctgaaatgtagactaaaaatggacaaactgactctaaaagggatgtcatatgtgatgtgcacaggctcatttaagctagagaaggaagtggctgagacccagcatggaactgttttagtgcaggttaaatacgaaggaacagatgcaccatgcaagatccccttttcgacccaagatgagaaaggagtgacccagaatagattgataacagccaatcctatagttactgacaaagaaaaaccagtcaacattgagacagaaccaccttttggtgagagctacatcgtggtaggggcaggtgaaaaagctttgaaacaatgctggttcaagaaaggaagcagcatagggaaaatgttcgaagcaaccgcccgaggagcacgaaggatggctatcctgggagacaccgcatgggacttcggttctataggaggagtgttcacgtctgtgggaaaattagtgcatcaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaactcaaatgtggaagtggcatttttgtcactaatgaagtccacacttggacagagcaatacaaatttcaagctgactccccaaaaagactatcagcagccatcggaaaggcatgggaggagggtgtgtgtggaattcgatcagccactcgtctcgagaacatcatgtggaagcaaatatcaaatgaactgaaccacatcttacttgaaaatgacatgaaattcacagtggttgtaggagatgttgttgggatcttggcccaagggaaaaaaatgattagaccacaacccatggaacacaaatactcatggaaaagctggggaaaagccaaaatcataggagcagacatacagaacaccaccttcatcattgacggcccagatactccagaatgtcctgatgaccaaagagcatggaacatttgggaagttgaggactatgggttcggaattttcacgacaaacatatggttgaaattgcgtgactcctacacccaaatgtgtgaccaccggctaatgtcagctgccatcaaggacagcaaggcagtccatgctgatatggggtactggatagaaagtgaaaagaacgagacctggaagctggcaagagcctctttcatagaagttaaaacatgtgtctggccaaaatcccacactctatggagcaatggagttctggaaagtgaaatgataattccaaagatctatggaggaccaatatctcagcacaactacagaccaggatatttcacacaaacggcagggccatggcacctaggcaagttggaactggattttgatttgtgtgagggtaccacagttgttgtggatgaacattgtggaaatcgaggtccatctcttagaaccacaacagtcacaggaaagataattcatgaatggtgttgcagatcttgtacgctaccacccttacgtttcaaaggagaagatggatgttggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagcagaaaaatgctgatgactggaacactggctgtgttcctccttctcataatgggacaattgacatggaatgatctgatcaggttatgcatcatggttggagccaatgcttcagacaggatggggatgggaacaacgtacctagctctgatggccacttttaaaatgagaccaatgtttgctgtcgggctgttgttccgcagactaacatctagagaagttcttcttcttacaattggattgagtctagtggcatctgtggagttaccaaattccctggaggagctgggggatggacttgcaatgggcattatgattttaaaattattgactgactttcagtcacatcagctgtgggctaccttgctgtccttgacatttgtcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttctcatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttacgttatatctggaagctcagccgacttatcactagagaaagcggctgaggtctcctgggaagaagaagcagaacactctggtgcctcacacaatatattagtggaggtccaagatgatggaaccatgaagataaaagatgaagagagagatgacacgctaaccattctccttaaagcaaccctgctagcagtttcaggggtgtacccattatcaataccagcaaccctttttgtgtggtacttttggcagaaaaagaaacaaagatctggagtgttatgggacacacctagccctccagaagtggaaagagcagtccttgatgatggtatctatagaattatgcagagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatatggaggaggttggaggtttcaaggatcctggaacacgggagaagaagtgcaggtgattgctgttgaaccaggaaaaaaccccaaaaatgtacagacagcgccgggtaccttcaagacccctgaaggtgaagttggagctattgccctagattttaaacccggcacatctggatctcccatcgtgaacagagaaggaaaaatagtaggtctttatggaaatggagtagtgacaacaagtggaacctacgtcagtgccatagcccaagccaaagcatcacaagaagggcccctaccagagattgaggacgaggtgtttaggaaaagaaacttaacaataatggacctacatccaggatcggggaaaacaagaagatatcttccagccatagtccgtgaggccataagaaggaacgtgcgcacactaattttggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttaccgatccagccagcatagcgcgcagagggtacatctcaacccgagtgggcatgggtgaagcagctgcgatcttcatgacagccactcccccaggatcggtggaggcctttccacagagcaatgcagttatccaagatgaggaaagagacattcctgagagatcatggaactcaggctatgagtggatcactgacttcccaggtaaaacagtctggtttgttccaagcatcaaatcaggaaatgacattgccaactgcttaagaaagaatgggaaacgggtgattcaattgagcaggaaaacctttgatacagagtaccaaaaaacaaaaaacaacgactgggactatgtcgtcacaacagatatctccgaaatgggagcaaacttccgagccgacagggtgatagacccaagacggtgtctgaaaccggtaatactaaaagatggtccagagcgcgtcattctagccggaccgatgccagtgactgtggccagtgctgcccagaggagaggaagaattggaaggaaccaaaacaaagaaggtgatcagtacgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaagaaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatgtggacaaaagaaggagaacgaaagaaactacgaccccgctggctggatgccagaacatactcagacccactggccctgcgcgagtttaaagagtttgcagcaggaagaagaagtgtctcaggtgatctaatattagaaatagggaaacttccacaacacttgacgcaaagggcccagaatgccttggacaacctggttatgttgcacaactccgaacaaggaggaagagcctacagacatgcaatggaagaacttccagacaccatagaaacgttgatgctcctagctttgatagctgtgttaactggtggagtgacgctgttcttcctatcaggaaagggcctagggaaaacatctattggcctactctgcgtgatggcttcaagcgtactgctatggatggccagcgtggagcctcattggatagcggcctccatcatactagagtttttcctgatggtgctgcttattccagagccagacagacagcgcactccacaggacaaccagttagcatatgtggtgataggtttgttattcatgatactcacagtggcagccaatgagatgggattattggaaaccacaaagaaagacttagggattggccatgtagccgccgaaaaccaccaccatgctacaatgctggacgtagacctacgtccagcttcagcctggaccctctatgcagtagccacaacagttatcacccccatgatgagacacacaattgaaaatacaacggcaaatatttccctgacagccattgcaaaccaggcagctatattgatgggacttgataaaggatggccaatatcgaagatggacataggagttccacttctcgccttggggtgctattcccaggtgaatccactgacgctgacagcggcggtattgatgctagtggctcattacgccataattggacctggactgcaagcaaaagcgactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgtgaatccatcacactggccactggacctctgaccacgctttgggagggatctccaggaaaattttggaacaccacgatagcggtttccatggcaaacattttcaggggaagttatctagcaggagcaggcctggccttctcattaatgaaatctctaggaggaggtaggagaggtacgggagccaaggggaaacactgggagagaaatggaaaagacagactgaaccaactgagcaagtcagaattcaacacttacaaaaggagtgggattatggaagtggacagatccgaagccaaagagggactgaaaagaggagaaacaaccaaacatgcagtgtcgagaggaaccgccaaattgaggtggttcgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaggaaccaatcccaatggcgacctatggatggaacctagtaaagctatactccgggaaagacgtattctttacaccacctgagaagtgtgacacccttttgtgtgatattggtgagtcctctccaaacccaactatagaagaaggaagaacgttacgcgtcctaaagatggtggaaccatggctcagagggaaccaattttgcataaaaattctaaatccctacatgccaagtgtggtggaaactctggagcaaatgcaaagaaaacatggaggaatgctagtgcggaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacttaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgccatccccatggtcacacaaatagccatgactgacaccacaccctttggacaacagagggtgtttaaagagaaagttgacacgcgcacaccaaaagcaaaacgaggcacagcacaaatcatggaggtgacagccaggtggttatggggttttctctctagaaacaaaaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagtagagagaattcactcagtggagtggaaggagaaggactccacaaactcggatatatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtaagggtacagagaccagcgaaaaatggaaccgtgatggatgtcatatccagacgtgaccagagaggaagtggccaggtcggaacttatggcttaaacactttcactaacatggaagcccagctaataagacaaatggagtctgagggaatcttttcacccagcgaattggagaccccaaatttagccgagagagttctcgactggctggaaaaatatggcgtcgaaaggctgaaaagaatggcaatcagcggagatgactgcgtggtgaaaccaattgatgacaggttcgcaacagccttaacagctctgaatgatatgggaaaagtaagaaaagatataccacaatgggaaccctcaaaaggatggaatgattggcaacaggtgcctttttgttcacaccatttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagctgctaatgctatctgttcagccgttccagttgattgggtcccaaccagccgcaccacttggtcgatccatgcccatcaccaatggatgacaacagaagacatgttgtcagtgtggaatagggtttggatagaggaaaacccatggatggaggacaaaacccatgtatccagttgggaagatgttccatatttaggaaaaagggaagatcagtggtgtggatccctgataggcttaacagcaagggctacctgggccaccaacatacaagtggccataaaccaagtgagaagactaatcgggaatgagaattatctagattacatgacatcaatgaagagattcaagaacgagagtgatccgaaggggcactctggtgagtcaacacacttatga

SEQ ID NO: 54 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgattaaagtgttacggggtttcaagaaagaaatctcaaacatgttgaatataatgaatagaaggaagagatcagtgaccatgctccttatgctgctgcccacaaccttggcgtttcatctgaccacacgagggggagagccgcatatgatagttaccaagcaggaaagaggaaagtcacttttgtttaagacctcagctggtgtcaacatgtgcacccttattgcaatggatttgggagagttatgtgaggacacaatgacttacaaatgtcctcgaatcactgaggcggaaccagatgacgttgactgttggtgcaatgccactgacacatgggtgacctatggaacatgttctcaaactggcgaacaccgacgagacaaacgttccgtcgcactggctccacacgtgggacttggtctagaaacaagaaccgaaacgtggatgtcctctgaaggcgcttggaaacaaatacaaagagtggagacttgggccctgagacacccaggattcacagtgatagccctttttctagcacacgccataggaacatccatcacccagaaagggattgtcttcattttgttgatgctggtaacaccatccatggccatgcgatgtgtgggaataggcaacagggacttcgtggaaggactgtcaggagcaacgtgggtagatgtggtactggaacatggaagttgtgtcaccaccatggcaaaagataaaccaacattggacattgaactcttgaagacggaagtcacaaaccctgccgtcctgcgcaaactgtgcattgaagccaaaatatcaaacactaccaccgactcaagatgtccaacacaaggagaggccacactggtggaagaacaagacgcgaattttgtgtgtcgacgaacgtttgtggacagaggctggggcaatggctgtgggctttttggaaaaggtagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatggaacaacagcaactataacgcctcaagctcccacgtcggaaatacagctgaccgactacggagctcttacactggattgctcacctagaacaggactagacttcaatgaaatggtgttgttgacaatgaaagaaaaatcatggctagtccacaaacaatggtttctagacctaccactgccttggacctcgggagctacaacgtcacaagagacttggaacagacaagatttgctggtaacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaaaatggacaaactgactctaaaagggatgtcatatgtgatgtgcacaggctcattcaagctagagaaagaggtggctgagacccagcatggaaccgttctagtgcaggttaaatacgaaggaacagatgcaccatgcaagatccctttttcgacccaagatgaaaaaggagtaacccagaatgggagagtgataacagccaaccctatagtcactgacaaggaaaaaccagtcaacattgaggcagaaccaccttttggtgagagttacatcgtggtaggagcaggtgaaaaagctttgaaactaagctggttcaagaaaggaagcaccatagggaaaatgtttgaggcaaccgcccgaggagcacgaaggatggccatactgggagacaccgcatgggactttggttccataggaggagtgttcacatctgttggaaaactagtacaccagatttttggaactgcatatggagttttgttcagcggtgtttcctggaccatgaaaataggaataggggttctgctgacatggctaggattaaactcaaggagcacgtctctttcgatgacgtgcattgcagttggcctggtaacactgtacctaggagtcatggttcaggcggattcaggatgtgtaattaactggaaaggcagagaactcaaatgtggaagtggcatttttgtcaccaatgaagttcacacttggacagagcaatacaaatttcaggctgactccccaaagagactatcagcagccatcgggaaggcatgggaggagggtgtgtgtggaattcgatcagccactcgtctcgagaacatcatgtggaagcaaatatcaaatgaactgaaccacattttacttgaaaatgacatgaaattcacagtggttgtaggagatgttagtgggatcttggcccaaggaaaaaaaatgattaggccacaacccatggaatacaaatactcgtggaaaagctggggaaaagctaaaatcataggggcagatgtacagaactccactttcatcattgacggcccaaacaccccagaatgccctgatgatcaaagagcatggaacatttgggaagttgaggactatggatttggaattttcacgacaaacatatggttgaaattgcgtgactcctacacccaagtgtgtgaccaccggctaatgtcagctgccatcaaggacagcaaggcagttcatgctgacatggggtactggatagaaagtgaaaagaacgagacttggaagctggcaagagcctccttcatagaagttaaaacatgcgtttggccaaaatcccacactctatggagcaatggagttctggaaagtgaaatgataattccaaagatatatggaggaccaatatctcagcacaactacagaccaggatatttcacacaaacagcagggccgtggcacctaggcaagttggaactagattttaatttgtgtgagggtaccacagttgttgtggatgaacattgtggaaatcgaggaccatctcttagaaccacaacagtcacaggaaaaataatccatgaatggtgctgcagatcttgtacgctaccacccttacgtttcaaaggagaagatgggtgttggtatggtatggaaattagaccagtcaaggaaaaggaagagaatctagtcaaatcaatggtctctgcagggtccggagaagtggacagcttttcactaggactgctatgcatatcaataatgaccgaagaggtgatgagatctagatggagcagaaaaatgctgatgactggaacactggctgtgttcctccttctcataatgggacaattgacatggaatgatctgatcaggttatgcatcatggttggagccaatgcttcagacaggatggggatgggaacaacgtacctagctctgatggctacttttaaaatgagaccaatgtttgctgtcgggctattattccgcagactaacatctagagaagttcttcttcttacaattggattgagtctagtggcatccgtggagctaccaaattccttggaggagctgggggatggacttgcaatgggcattatgatcttaaaattactgactgactttcaatcacatcagctgtgggctgccttgctgtccctgacatttattaaaacaactttttctttgcactatgcatggaagacaatggctatggtactgtcaattgtgtctctcttccccctatgcctgtccacgacctctcaaaaaacaacatggcttccggtgctattgggatctcttggatgcaaaccactaaccatgtttctcatagtagaaaacaaaatttggggaaggaaaagttggcctctcaatgaaggaatcatggctgttggaatagtcagcatcttactaagctcactcctcaaaaatgacgtgccgctagctgggccactaatagctggaggcatgctaatagcatgttatgtcatatctggaagctcagccgatttatcattagagaaagcggctgaggtttcctgggaagaagaagcagaacactctggtgcctcacacaatatattagtggaggtccaagatgatggaaccatgaagataaaagatgaagagagagatgacacactaaccattttacttaaagcaactttgctggcagtttcagggatgtacccattatcaataccagcgaccctttttgtgtggtatttttggcagaaaaagaaacagagatcaggagtgttatgggacacacctagccctccagaagtggaaagagcagttcttgatgatggtatctatagaattatgcagagaggactgttgggcagatcccaagtaggggtaggagttttccaagaaaacgtgttccacacaatgtggcatgtcaccaggggagctgtactcatgtatcaagggaagagactggaaccaagttgggctagtgtcaaaaaagacctgatctcatatggaggaggttggaggcttcaaggatcctggaacacgggagaagaagtgcaggtgatcgctgttgaaccaggaaaaaaccccaaaaatgtacagacagcgccgggcaccttcaagacccctgaaggtgaagttggagccatagccctagattttaaacccggcacatctggatcccccatcgtgaacagagaggggaaaatagtaggtctttatggaaatggagtagtgacaacaagtggaacctacgtcagtgccatagctcaagctaaagcatcacaagaagggcccctaccagagattgaggacgaggtgtttaggaaaagaaacttaacaataatggacctacatccaggatcgggaaaaacaagaagatatcttccagccatagtccgtgaggccataaagaggaagctgcgcacactaattttggctcccacaagagttgtcgcttccgaaatggcagaggcgctcaaaggaatgccgataaggtatcagacaacagcagtgaagagtgaacacacaggaaaagagatagttgacctcatgtgccacgccactttcactatgcgtctcctgtctcccgtgagagttcccaattacaacatgattatcatggatgaagcacatttcaccgatccatccagcatagcggccagagggtacatctcaacccgagtgggtatgggtgaagcagctgcgatcttcatgacagccactcccccaggatcggtggaggcctttccacagagtaatgcagttatccaagatgaggaaagagacattcctgagagatcatggaactcaggctatgactggatcactgacttcccaggtaaaacggtctggtttgttccaagcatcaaatcaggaaatgacattgccaactgtttaagaaagaatgggaaacgggtgattcaattgagcaggaaaacctttgacacagagtaccaaaagacaaaaaacaacgactgggactatgtcgtcacaacagacatctccgaaatgggagctaacttccgagccgacagggtaatagacccaagacggtgtctgaaaccggtaatactaaaagatggtccagagcgtgtcattctagcaggaccgatgccagtgactgtggccagtgccgcccagaggagaggaagaatcggaaggaaccaaaacaaggaaggtgatcagtacatctacatgggacagcctttaaataacgatgaagaccacgctcattggacagaagcaaaaatgctccttgataatataaacacaccagaagggattatcccagccctctttgaaccggagagagaaaagagtgcggcaatagacggggaatatagactgcggggtgaagcaaggaaaacgtttgtggagctcatgagaagaggggatctacctgtctggctatcctacaaagttgcctcagaaggcttccagtactctgacagaagatggtgctttgatggggaaaggaacaatcaggtgttggaggagaacatggacgtggagatctggacaaaagaaggagaaagaaagaaactacgaccccgctggctggatgccagaacatactcagacccattggccctgcgcgagttcaaagagtttgcagcaggaagaagaagcgtctcaggtgatctaatattagaaatagggaaacttccacagcacttgacgcaaagggcccagaacgccttggacaacctggtcatgttgcacaactctgaacaaggaggaagagcctacagacatgcaatggaagaactcccagacaccatagaaacgttgatgctcctagctttgatagctgtgttaactggtggggtgacgttgttttttctatcaggaaggggcttagggaaaacatctatcggcctactctgcgtggtggcttcaagcgtgttgttatggatggccagtgtggagccccattggatagcagcctccatcatactagaattctttctgatggtgctgcttattccagagccagacagacaacgcactccacaggacaaccagttggcatatgtagtgataggcttgttattcatgatactgacagtagcagccaatgagatgggattactggaaaccacaaagaaagacttagggattggccatgtggctgttgaaaatcaccaccatgccacaatgttggacgtagacttacatccagcttcagcctggaccctctatgcagtggccacaacaattatcactcccatgatgaggcacacaatcgaaaacacaacggcaaatatttccctgacagctattgcaaaccaggcagccatattgatgggactcgacaaaggatggccaatatcgaagatggacataggagttccacttctcgccctggggtgctattcccaggtgaatccactgacgctgacagcggcagtattgatgctagtggctcattatgccataattggacctggactgcaagcaaaagctactagagaagcccaaaaaaggacagcggctggaataatgaagaatccaaccgtcgatggaataattgcaatagatttggaccctgtggtttatgatgcaaaatttgagaaacaactaggccaaataatgttgttgatactatgcacatcacagatcctcttgatgcggactacatgggccttgtgtgaatccatcacgctggctactggacctctgaccacgctttgggaaggatctccaggaaaattttggaacaccacgatagccgtgtccatggcaaacatattcaggggaagttatctagcaggagcaggcctggccttctcactaatgaaatctctaggaggaggtaggagaggcacgggagcccaaggggaaacactgggagaaaaatggaaaagacagctaaaccaactgagcaagtcagaatttaacacttacaaaaggagtgggattatagaagtggatagatccgaagccaaagagggactgaaaagaggagaaacaaccaaacatgcagtgtcgagaggaaccgccaaactgaggtggtttgtggagaggaaccttgtgagaccagaagggaaagtcatagacctcggttgtggaagaggtggctggtcatattattgcgccgggctgaagaaagtcacagaagtgaagggatacacaaaaggaggacctggacatgaagaaccaatcccaatggcgacctatggatggaacctagtaaagctgtactctgggaaagacgtgttctttacaccacctgagaaatgtgacacccttttatgtgatattggtgagtcctctccgaacccaaccatagaagaaggaagaacgttacgtgtcctaaagatggtggaaccatggctccgaggaaaccaattttgcataaaaattctaaatccctacatgccaagcgtggtggaaactctggagcaaatgcaaagaaaacatggaggaatgctagtgcgaaatccactctcaagaaattccactcatgaaatgtattgggtttcatgtggaacaggaaacattgtgtcagcagtaaacatgacatctagaatgttgctaaatcgattcacaatggctcacaggaaaccaacatatgaaaaagacgtggacttaggcgctggaacaagacatgtggcagtggaaccagaggtagccaacctagatatcattggccagaggatagagaacataaaacatgaacataagtcaacatggcattatgatgaggacaatccatacaagacatgggcctatcatggatcatatgaggtcaagccatcaggatcagcctcatccatggtcaatggcgtggtgagactgctcaccaaaccatgggatgtcattcccatggtcacacaaatagccatgactgacaccacaccctttggacaacagagggtgtttaaagagaaagttgacacgcgcacaccaaaagcaaaacaaggcacagcacaaatcatggaagtgacagctagatggttatggggttttctttctagaaacaaaaaaccaagaatctgcacaagagaggagttcacaagaaaagttaggtcaaacgcagctattggagcagtgttcgttgacgaaaatcaatggaactctgcaaaagaagcagtggaagatgaacggttttgggaccttgtgcacagagagagggagcttcacaaacagggaaagtgtgccacgtgtgtttacaatatgatggggaagagagagaaaaaactaggagagttcggaaaggcaaaaggaagtcgtgcaatatggtacatgtggttgggagcacgctttctagagtttgaagcccttggtttcatgaacgaagatcactggttcagtagagagaattcactcagtggagtggaaggagaaggactccatagactcggatatatactcagagacatatcaaagattccagggggaaatatgtatgcagatgacacagccggatgggacacaaggataacagaggatgatcttcagaatgaggccaaaatcactgacatcatggagcccgaacatgccctactggctacgtcaatttttaagctgacctaccaaaacaaggtggtgagggtgcagagaccagcaaaaaatggaaccgtgatggatgttatatccagacgtgatcagagaggaagtggccaggtcggaacttatggcttaaacactttcaccaatatgggggtccagctaataagacaaatggagtctgagggaatcttttcacccagcgaattagagaccccaaatttggccgagagagttctcgactggttggaaaagtatggcgtcgaaaggctgaaaagaatggcaatcagcggagatgactgcgtggtgaaaccaattgatgacaggttcgcgacagccctaacagctctgaacgacatgggaaaagtaagaaaagacataccacaatgggaaccttcaaaaggatggaatgactggcaacaagtgcctttttgttcacaccatttccaccagctgattatgaaggatgggagggaaatagtggtgccatgccgcaatcaagatgaactcgtgggtagggctagagtgtcacaaggtgccggatggagcctgagagaaactgcatgcctgggcaagtcatatgcacaaatgtggcagctgatgtatttccacaggagagacctgagactagctgctaatgccatctgctcggccgttccagttgattgggtcccaaccagccgcaccacctggtcgatccatgcccatcatcaatggatgacaacagaaaacatgttgtcagtgtggaatagggtttggatagaggaaaacccatggatggaggacaaaacccatgtatccagctgggaagatgttccatacttagggaaaagggaagatcagtggtgtggttccctgataggtttaacagcaagggccacctgggccaccaacatacaagtggccataaaccaagtgagaaggctaattgggaatgagaattatctagattacatgacatcaatgaagagattcaagaacgagagcgatcccgaaggggcactctggtga

SEQ ID NO: 55 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggccttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcagaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggatggggaaatggttgtgggctcttcggaaaaggaagcctaataacgtgtgctaagttcaagtgtgtgacaaaactggaaggaaagatagtacaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtgcacaaacaatggtttttagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccccttttcgacccaagatgaaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattggtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcatcatccattgggaaggcatgggaggagggtgtgtgtggaattcgatcagcaacgcgtctcgagaacatcatgtggaagcaaatatcaaatgaactgaaccacatcttacttgaaaatgacatgaaattcacagtggttgtaggagatgttgctgggattttggctcaagggaaaaagatgattaggccacaacccatggaatacaaatactcgtggaaaagctggggaaaggctaaaatcataggggcagatgtacagaacgccaccttcatcatcgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggatactggatagaaagtgaaaagaacgagacctggaagctggcaagagcctctttcatagaagttaaaacatgtgtctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaacctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacctacctagctctgatggccacttttaaaatgagaccaatgtttgctgtagggctattattccgcagactaacatccagagaagttcttcttctaacaattggactgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgttaatagcatgttatgttatatctggaagctcagccgatctatcactagagaaagcggccgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatttatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagacccctgaaggtgaagttggagctattgccctagattttaaacccggcacatctggatctcccatcgtgaacagagaaggaaaaatagtaggtctttatggaaatggagtagtgacaacaagtggaacctacgtcagcgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatggaaaacgggtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgttattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacttttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacatttgacgcaaagggcccagaatgccttggacaacctggttatgttgcacaactccgaacaaggaggaagagcctatagacatgcactggaagaactgccagacaccatagaaacgttgatgctcctagctttgatagctgtgttaactggtggagtgacgctgttcttcctatcaggaaggggcctagggaaaacatctattggcctactctgcgtgatggcttcaagcgtactgctatggatggccagtgtggagccccattggatagcggcctccatcatactggagttcttcctgatggtgctgctcattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgcctcaatgctggacgtagacttacacccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgttaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaaccaatggaactcagcaaaagaagcggtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaagtcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttctcccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacttgagactagccgctaatgctatctgttcagccgttccagttgattgggtcccaaccagccgcaccacctggtcgatccatgcccaccaccaatggatgacaacagaagacatgctgtcagtgtggaatagggtttggatagaggaaaacccatggatggaggacaaaacctatatatccagttgggaagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 56 - DNA, 10179 bp, Dengue virus
atgaacaaccaacggaagaagacgggtcgaccgtctttcaatatgctgaaacgcgcgagaaaccgcgtgtcaactggttcacagttggcgaagagattctcaaaaggattgctctcaggccaaggacccatgaaattggtgatggctttcatagcattcctaagatttctagccatacccccaacagcaggaattttggctagatggagctcattcaagaagaacggagcgatcaaagtgttacggggtttcaaaaaagagatctcaagcatgctgaacataatgaacaggaggaaaagatcagtgaccatgcttcttatgctgttgcccacagccctggcattccatttgaccacacgagggggagagccacatatggtagttagcaagcaggaaagaggaaagtcactcttgtttaagacctctgcaggtgtcaacatgtgcaccctcattgcgatggatttgggagagctatgtgaggatacaatgacctacaaatgcccccggatcactgaggcggaaccagatgacgttgactgctggtgcaatgccacagacacatgggtgacctacggaacgtgttctcaaactggcggacaccgacgagataagcgttctgtcgcactggccccacacgtgggactgggtctagaaacaagaactgaaacatggatgtcttctgaaggcgcctggaaacaaatacaaaaagtggagacttgggccctgagacacccaggatttacggtgatagccctttttctagcacatgccataggaacatccatcacccagaaagggattattttcattctgctgatgctggtgacaccatcaatggccatgcgatgcgtgggaataggcaacagagacttcgttgaaggactgtcaggagcaacatgggtggatgtggtactggagcatggaagctgcgtcaccaccatggcgaaaaataaaccaacattggacattgaactcttgaagacggaagtcacgaaccctgctgtcttgcgcaaactgtgcattgaagctaaaatatcaaataccaccaccgattcaagatgtccaacacaaggagaagctacactggtggaagaacaagacgcgaactttgtgtgtcgacgaacgttcgtggacagaggctggggtaatggctgtggactattcggaaaaggaagcctactgacgtgtgccaagttcaagtgtgtgacaaaacttgaaggaaagatagttcaatacgaaaacttgaaatatacagtgatagtcactgtccacactggggaccagcatcaagtgggaaatgagaccacagaacatggaacaattgcaaccataacacctcaagctcccacgtcggaaatacagctgaccgactacggagccctcacattggactgctcacctagaacagggctggactttaatgagatggtgctgctgacaatgaaagaaaaatcgtggcttgtccacaaacaatggtttctagacttaccattgccttggacctcgggggcttcgacatctcaagagacttggaacagacaagatctactggtcacatttaagacagctcatgcaaagaagcaggaagtggtcgtgttgggatcacaagaaggagcaatgcacactgcgctgactggggcgacggaaatccagacgtcaggaacgacaacaatttttgcagggcacctgaaatgcagactaaaaatggataaactcactctaaaagggatgtcatatgtgatgtgcacaggctcatttaagttagagaaggaagtggctgagacccagcatggaaccgtcttagtgcaggttaaatacgaaggagcagacgcaccatgcaagatacccttttcgacccaagatgagaaaggagtgacccagaatgggagattgataacagccaatcccatagttactgacaaagaaaaaccagtcaacatcgagacagaaccaccttttggtgagagctacatcgtgataggggcaggtgaaaaagctttgaaactaagctggttcaagaaaggaagcagcatagggaaaatgttcgaagctaccgcccgaggagcacgaaggatggccatcctgggagacaccgcatgggacttcggttctataggaggagtgttcacatctgtgggaaaattggtacaccaggtctttggagccgcatatggggttttgttcagcggtgtttcttggaccatgaaaataggaatagggattctgctgacatggctgggaataaattcaaggagcacgtcactttcgatgacgtgcattgcagttggcatggtcacgctgtacctaggagtcacggtccaagcggactcggggtgtgtaatcaattggaagggcagagaactcaaatgtggaagtggtatttttgtcactaatgaagtccacacttggacagagcaatataaattccaggctgactccccaaaaagactgtcagcagccattgggaaggcatgggaggagggcgtgtgtggaattcgatcagccacacgtcttgagaacatcatgtggaagcaaatatcaaatgaattgaaccacattctacttgaaaatgacatgaagttcacagtggttgtaggagatgccaatggaattttgacccaagggaaaaaaatgattaggccgcagcccatggaacacaaatactcatggaaaagctggggaaaagccaaaattataggagcagacatacagaataccactttcatcatcgatggcccagacactccagaatgccccgatgaccaaagagcatggaacatttgggaagtcgaggactatggatttggaattttcacgacaaacatatggttgaaattgcgtgactcctacacccaaatgtgtgaccaccgactaatgtcagctgccatcaaggacagcaaggcagtccatgctgatatggggtattggatagaaagtgaaaagaacgagacctggaagctagcgagagcctccttcatagaagttaagacatgcatctggccaagatctcacactctatggagtaatggagttttggaaagtgaaatgataatcccaaagatatatggaggaccaacatctcagcacaactacagaccagggtatttcacacaaacagcagggccatggcacctaggcaagttggaattagattttgatctgtgtgaaggcaccacagttgttgtggatgaacattgtggaaatcgaggtccatctcttagaactacaacagtcacaggaaagataatccatgaatggtgttgcagatcctgcacattaccccccttacgcttcaaaggagaagacggatgttggtacggcatggaaatcagaccagttaaggagaaggaagagaacctagttaggtcaatggtctctgcagggtcaggagaagtggacagtttttcattgggactactatgcgtgtcaataatgattgaagaagtgatgagatccagatggagtagaaagatgctgatgactggaacactggctgttttcttcctcctcataatggggcaactgacatggaatgatctgatcagggtatgcatcatggttggagccaatgcttcagacaggatggggatgggaacaacgtacctagccttgatggccactttcaaaatgagaccaatgttcgctgttgggctattatttcgcagactaacatccagagaagttcttcttcttacaatcggattaagcctggtggcatccgtggagctaccaaattctctagaggagctaggggatggacttgcaatgggcattatgatgttaaaattattgactgattttcagtcacaccagttatggactaccttactatctctgacattcatcaaaacaaccctttcattggattacgcatggaagacaatggctatggtactgtcaatcatatctctctttcccttatgtctatctacgacctctcaaaaaacaacatggcttccggtgctgttaggatcttttggatgcaaaccactaaccatgtttcttataacagaaaacaaaatctggggaaggaaaagttggcccctcaatgaaggaattatggctgttggaatagttagcattctactaagttcactccttaaaaatgatgtgccactagctggcccactaatagctggaggcatgctaatagcatgttatgtcatatccggaagctcagccgatttgtcattggaaaaagctgctgaggtctcctgggaagaagaagcagaacactctggtgcctcacacaacatattggtagaggtccaagatgatggaaccatgaaaataaaagatgaagagagagatgacacgctcacaatactcctcaaagcaactctgctggcagtctcaggggtgtacccaatgtcaattccagcgaccctttttgtgtggtatttttggcagaaaaagaaacagagatcaggagtgttgtgggacacacccagccctccagaagtggaaagagcagttcttgatgatggtatctacagaatcttgcagagaggactgttgggtaggtcccaagtaggagtgggagttttccaagacggcgtgtttcacacgatgtggcacgtcactaggggagctgtcctcatgtaccaagggaagaggctggaaccaagttgggccagtgtcaaaaaagacttgatttcatatggaggaggctggaggtttcaaggatcatggaacacgggagaagaagtgcaggtgatagctgttgaaccagggaaaaaccccaaaaatgtacagacaacgccgggtaccttcaagacccctgaaggcgaagttggagccatagccctagacttcaaacccggcacatctggatctcccatcgtgaacagagagggaaaaatagttggtctttatggaaatggagtagtgacaacgagtggaacctacgtcagtgctattgcccaagctaaagcatcacaagaagggcctctaccagaaattgaggacgaggtgttcaggaaaagaaacttaacaataatggacctgcatccaggatcaggaaaaacaagaagatatcttccagccatagtccgtgaggccataaaaaggaaactgcgcacgctaatcttggcccccacaagagttgtcgcctctgaaatggcagaggcgcttaagggaatgccaataagatatcaaacaacagcagtaaagagcgaacacacaggaagggagatagttgacctcatgtgccacgccactttcaccatgcgtctcctatctccagtgagagttcccaattacaacatgattatcatggatgaagcacatttcaccgatccagctagcatagcggccagagggtacatctcaacccgagtgggtatgggtgaagcagccgcgatctttatgacagcccctcccccaggatcggtggaggcctttccacagagcaatgcagttatccaagatgaggaaagagacattcctgagagatcatggaactcaggctacgactggatcactgactttccaggtaaaacagtctggtttgtcccaagcatcaaatcaggaaatgacattgccaactgtttaagaaagaacgggaaacgggtgatccaattgagcagaaaaacttttgacactgagtaccagaaaacaaaaaacaatgactgggactatgttgtcacaacagacatttccgaaatgggagcaaatttccgggccgacagggtaatagacccaaggcggtgtttgaaaccggtaatactaaaagatggtccagagcgcgttatcctagccggaccgatgccagtgactgtggccagtgctgcccagaggagaggaagaattggaaggaaccaaaacaaggaaggtgatcagtatgtttacatgggacagcctttaaacaatgatgaggaccacgctcattggacagaagcaaaaatgctccttgacaatataaacacaccagaagggattatcccagccctctttgagccagagagggaaaagagtgcagcaatagacggggagtacagactacggggagaagcaaggaaaacgttcgtggagctcatgaggagaggagatctaccagtttggctatcttacaaagttgcctcagaaggcttccagtattccgacagaaggtggtgctttgatggggaaaggaacaaccaagtgctggaggagaacatggacgtggagatctggacaaaggaaggagaaagaaagaaactacgacctcgctggttggatgccagaacatactctgatccactggcccttcgcgagttcaaagagtttgcagcaggaagaagaagtgtctcaggtgacctaatattagaaatagggaaacttccacagcatttgacgctaaaggcccagaatgctttggataacttggtcatgttgcataattccgaacaaggaggaaaagcctatagacatgccatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgtactgttatggatggccagtgtggagccccattggatagcggcctccatcatactagagttctttttgatggtgctgctcattccagagccagacagacagcgcaccccacaggacaaccagctagcatatgtggtgataggtttgttattcatgatactgacagtggcagccaatgagatgggattattggaaaccacaaagaaagacctggggatcggccacgtggttgctgaaaaccaccaccatgctacaatgctggacatagacctacatccagcctcagcctggaccctttatgcagtagccacaacaattatcactcccatgatgagacacacaattgaaaacacaacggcaaacatttctctgacagctattgcaaatcaggcggctatattgatgggacttgacaagggatggccaatatcgaagatggacataggagttccacttctcgccttagggtgctattcccaggtaaacccattgacactgacagcagcggtgttgatgctagtggctcactatgccataatcggacctggactgcaagcaaaagccactagagaagctcaaaaaaggacagcggccggaataatgaaaaatccaactgtagacgggattgtcgcaatagacttggatccagtggtttacgatgcaaaatttgaaaaacagctaggccaaataatgttactgatactttgcacatcacagattctcttgatgcggactacatgggccttatgtgaatccatcacactggctactggacccctgaccactctctgggagggatctccaggaaaattctggaataccacgatagcagtgtccatggcaaacatcttcagaggaagttacctagcaggagcaggtctggccttctcattaatgaaatctttaggaggagggaggagaggtacgggagctcaaggggaaacactgggagaaaaatggaaaagacagctaaaccaacttagcaagtcagaatttaacacctacaaaaggagtgggattatggaggtggatagatccgaagccaaggagggactaaaaagaggagaaacaaccaaacatgcagtgtcgagaggaacagccaaactgaggtggtttgtggagaggaacctcgtgaaaccagaagggaaagtcatagacctcggctgtggaagaggtggctggtcatattattgcgccgggctgaagaaggtcacagaagtgaagggatacacaaaaggaggacctggacatgaggaacctattccaatggcaacatatggatggaacctagtgaagctacactctggaaaagatgtgttcttcataccacctgagaaatgtgatacccttttgtgtgatattggtgagtcctctccgaatccaaccatagaagaaggaagaacgttacgtgttctgaagatggtggaaccatggctcagaggaaaccaattttgcataaaaatcttaaatccttacatgccaagtgtggtagagactctggagcaaatgcaaagaaaacatggagggatgctagtgcgaaacccactctcaagaaattccacccatgaaatgtactgggtttcatgtggaacaggaaacattgtgtcagcagtgaacatgacatccagaatgttgctgaaccgattcacaatggctcacaggaagccaacatatgaaaaagatgtggacctaggcgctggaacaagacatgtgacaatggaaccagaggtagccaacctggatatcattggccagaggatagagaatataaaaaatgaacataagtcaacatggcattatgatgaggacaatccatacaaaacatgggcctatcatggatcatatgaggtcaagccatcaggatcagcctcttccatggtgaatggcgtggtgagactgctcaccaaaccatgggatgtcatccccatggtcacacaaatagctatgactgacaccacacccttcggacaacaaagggtgtttaaagagaaagttgacacgcgcacaccaagagcaaaacgaggcacagcacaaatcatggaagtgacagccaagtggttatggggtttcctttctagaaacaaaaaacccagaatctgcacaagagaggagttcacaagaaaagttaggtcaaatgcagctattggagcagtatttgttgatgaaaaccaatggaactcagcaaaagaagcagtggaagacgaaaagttctgggatcttgtgcacagagagagggagcttcataaacagggaaaatgtgctacgtgcgtctacaacatgatgggaaaaagagagaaaaagttgggagagtttggaaaagcaaaaggaagtcgtgcaatatggtatatgtggctgggagcacgctttctagagttcgaagcccttggcttcatgaatgaagatcactggttcagtagagagaattcactcagtggagtggaaggagaaggactacacaaacttggatacatactcagagacatatcaaagattccagggggaaatatgtatgcagatgacacagctgggtgggacacaagaataacagaggacgatcttcagaatgaggctaaaatcactgacatcatggaacctgaacatgctctattggccacgtcaatctttaagctgacctaccaaaataaggtggtaagggtgcaaagaccagcaaaaagtggaaccgtgatggatgtcatatctagacgtgaccagagaggaagcggacaggtcggaacttatggtttaaatactttcaccaacatggaggtccaactaataagacaaatggaatctgagggaatcttttcacccagcgaattggaaacccctaatctagcagagagagttctcgactggttggaaaaacatggcgtcgaaaggttgaaaagaatggcaatcagcggagatgactgcgtggtgaaaccaactgatgacagattcgcaacagccttaacagctctgaatgacatgggaaaagtaagaaaagacataccacaatgggaaccttcaaaaggatggaatgactggcagcaagtgcctttctgctcacaccatttccaccaactgatcatgaaggatgggagggagatagtggtgccatgccgcaaccaagatgaacttgtgggcagggccagagtatcacaaggcgccggatggagcctgagagaaaccgcttgcctaggcaagtcatatgcacaaatgtggcagctgatgtacttccacaggagagacctgagactagcggctaatgctatctgttcagccgtcccagttgattgggttccaaccagccgcactacctggtcaatccatgcccaccatcagtggatgacaacagaagacatgttgtcagtgtggaatagggtttggatagaggaaaacccatggatggaagacaaaactcatgtgcccagttgggaggatgttccttacttgggaaaaagggaagatcaatggtgtggatccttgataggcttgacagcaagggccacctgggccaccaacatacaagtagccataaaccaagtgagaaggctcatcgggaatgagaattatctagattacatgacatcaatgaagagattcaagaatgagagtgatcccgaaggggcactctggtga

SEQ ID NO: 57 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggccttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgcgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatctgggagagttatgtgaggacacaatgacttacaaatgccctcgaatcactgaggcagaaccagatgacgttgattgttggtgcaatgccacagactcatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaacggctgtgggctcttcggaaaaggaagcctaataacgtgtgctaagttcaagtgtgtgacaaaactggaaggaaagatagtccaacatgaaaacttgaaatattcagtaatagtcaccgtccacactggagaccagcaccaggtgggaaatgaaagcacagaacatgggacaactgcaactataacacctcaagctcctacaacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacactgcatgggactttggttctataggaggagtgttcacgtctgttggaaaattggtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagtggcatttttgtcaccaatgaagtccacacttggacagagcaatacaaattccaggctgactccccaaagagactgtcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggattttggctcaagggaaaaaaatgattaggccacaacccatggaatacaaatactcgtggaaaagctggggaaaggctaaaatcataggggcagatgtacagaacaccaccttcatcatcgacggcccaaacaccccagaatgtcccgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggatactggatagaaagtgaaaagaacgagacctggaagctggcaagagcctctttcatagaagttaaaacatgtgtctggccaaaatcccacactctatggagcaatggagttctggaaagtgaaatgataattccaaagatctatggaggaccaatatcccagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagagaagaagatgggtgctggtacggtatggaaatcagaccagtcaaggaaaaggaagagaacctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctattattccgcagactaacatccagagaagttcttcttctaacaattggactgagtctagtggcatctgtggagttaccaaattccttggaggagctgggggatggacttgcaatgggcattatgattttaaaattattgactgactttcaatcacatcagctgtgggctaccctgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctaaaaaatgatgtgccgctagctgggccactaatagctggaggcatgctaatagcatgttatgttatatctggaagctcagccgatctatcactagagaaagcggccgaggtctcctgggaagaagaagcagaacactctggtgcctcacacaacatattagtggaggtccaagatgatggaaccatgaagataaaggatgaagagagagatgacacgctaaccattctcctcaaagcaactctgctagcagtttcaggggtgtacccattatcaataccagcgaccctttttgtgtggtacttttggcagaaaaagaagcagagatctggagtgttatgggacacacctagccctccagaagtggaaagagcagttcttgatgatggtatttatagaattatgcagagaggactgttgggcaggtcccaagtaggggtaggagtttttcaagaaaacgtgttccacacaatgtggcatgtcaccaggggagctgtactcatgtatcaagggaagagactggagccgagctgggccagtgtcaaaaaagacttgatctcatatggaggaggttggaggcttcaaggatcctggaacacaggagaagaagtgcaggtgattgctgttgaaccagggaaaaaccccaaaaatgtacaaacagcgccaggcacctttaagacccctgaaggtgaagttggagctattgccctagattttaaacccggcacatctggatctcccatcgtgaacagagaaggaaaaatagtaggtctttatggaaatggagtagtgacaacaagtggaacctacgtcagcgccatagctcaagctaaagcatcacaagaagggcccctaccagagattgaagacgaggtgtttaggaagagaaacttaacaataatggacctacatccaggatcggggaaaacaagaagataccttccagccatagtccgtgaggccataaaaaggaagctgcgcacactaattctggctcctacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgccttctgtcttccgtgagagttcccaattacaacatgattatcatggatgaagcacatttcaccgatccatccagcatagcggccagagggtacatctcaaccccagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatggaaaacgggtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgttattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccagagagagaaaagagtgcagcaatagacggggaatacagactgcggggtgaaccaaggaaaacttttgtggagctcatgagaagaggagatctacctgtttggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccaaaacatactcagacccactggccctgcgcgagtttaaagagtttgcaacaggaagaataagcgtctcaggtgatctaatattagaaatagggaaacttccacaacatttgacgcaaagggcccagaatgccttggacaacctggttatgttgcacaactccgaacaaggaggaagagcctatagacatgcactggaagaactgccagacaccatagaaacgttgatgctcctagctttgatagctgtgttaactggtggagtgacgttgttcttcctatcaggaaggggcctagggaaaacatctattggcctactctgcgtgatggcttcaagcgcactgctatggatggccagtgtggagccccattggatagcggcctccatcatactggagttcttcctgatggtgctgctcattccagagccagacagacaacgcactccgcaggacaaccagctggcatatgtggtgataggtctgttattcatgatactgacagtagcagccaatgagatgggactgctggaaaccacaaagaaagacttagggattggccatgtggctgttgaaaatcaccaccatgcctcaatgctggacgtagacttacacccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccattgaccctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgctgttgatactatgcacatcacagatcctcttgatgcggactacatgggccttgtgcgaatccatcacactggctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactaaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacacccttttatgtgatattggtgagtcctctccaaacccaactatagaggaaggaagaacgctacgcgtcctaaagatggtggaaccatggcttagaggaaaccaattttgcataaaaattctgaatccctacatgccaagtgtggtggaaactctggagcaaatgcaaagaaaacatggaggaatgctagtgcgaaatccactttcacgaaattctactcatgaaatgtattgggtttcatgtggaacaggaaacattgtgtcagcagtaaacatgacatccagaatgttgttaaatcgattcacaatggctcacaggaaaccaacatatgaaagagatgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcattcccatggtcacacaaatagccatgactgacactacaccctttggacaacagagggtgtttaaagagaaagttgacacgcgcacaccaaaagcaaaacgaggcacagcacaaatcatggaggtgacagccaggtggttatggggttttctttctagaaacaaaaaaccaagaatttgtacaagagaggagttcacaagaaaagttaggtcaaacgcagccattggagcagtgttcgttgatgaaaaccaatggaagtcagcaaaagaagcagtggaagatgagcggttctgggaccttgtgcacagagagagggagcttcacaaacagggaaaatgtgccacgtgtgtttacaacatgatggggaagagagagaaagaactaggagagttcggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaagtcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattggaaacccctaatctagcagagagagttctcgactggctggaaaaatatggcgtcgaaaggctgaaaagaatggcaatcagcggagatgactgcgtagtgaaaccaattgatgataggttcgcaacagccttaacagctctgaatgatatgggaaaagtaagaaaagatataccccaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacttgagactagccgctaatgctatctgttcagccgttccagttgattgggtcccaaccagccgcaccacctggtcgatccatgcccaccaccagtggatgacaacagaagacatgctgtcagtgtggaatagggtttggatagaggaaaacccatggatggaggacaaaacccatatatccagttgggaagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaaaaacgagagtgatcccgaaggggcactctggtga

SEQ ID NO: 58 - DNA, 10179 bp, Dengue virus
atgaacaaccaacggaagaagacgggtcgaccgtctttcaatatgctgaaacgcgcgagaaaccgcgtgtcaactggttcacagttggcgaagagattctcaaaaggattgctctcaggccaaggacccatgaaattggtgatggctttcatagcatttctaagatttctagccatacccccaacagcaggaattttggctagatggagctcattcaagaagaatggagcgatcaaagtgttacggggtttcaaaaaagagatctcaaacatgctgaacataatgaacaggaggaaaagatcagtgaccatgcttcttatgctgttgcccacagccctggcgttccatttgaccacacgagggggagagccacatatggtagttagcaagcaggaaagaggaaagtcactcttgtttaagacctctgcaggtgtcaacatgtgcaccctcattgcgatggatttgggagagctatgtgaggatacaatgacctacaaatgcccccggatcactgaggcggaaccagatgacgttgactgctggtgcaatgccacagacacatgggtgacctacggaacgtgttctcaaactggcgaacaccgacgagacaaacgttctgtcgcactggccccacacgtgggacttggtctagaaacaagaaccgaaacatggatgtcctctgaaggtgcctggaaacaaatacaaaaagtggagacttgggccttgagacacccaggattcacggtgatagccctttttctagcacatgccataggaacatccatcacccagaaagggattattttcattctgctgatgctggtgacaccatcaatggccatgcgatgcgtgggaataggcaatagagacttcgttgaaggactgtcaggagcaacatgggtggatgtggtactggagcatggaagctgcgtcaccaccatggcaaaaaataaaccaacattggacattgaactcttgaagacggaagtcacgaaccctgccatcttgcgcaaactgtgcattgaagctaaaatatcaaataccaccaccgattcaagatgtccaacacaaggagaagctacactggtggaagaacaagacgcgaactttgtgtgtcgacgaacgttcgtggacagaggctggggtaatggctgtggactattcggaaaaggaagcctactgacgtgtgctaagttcaagtgtgtgacaaaacttgaaggaaagatagttcaatatgaaaacttaaaatattcagtgatagtcactgtccacactggggaccagcaccaggtgggaaatgagactacagaacatggaacaattgcaaccataacacctcaagctcccacgtcggaaatacagctgaccgactacggagccctcacattggactgctcacctagaacagggctggactttaatgagatggtgctgctgacaatgaaagaaaaatcgtggcttgtccacaaacaatggtttctagacttaccattaccttggacctcgggggcctcgacatctcaagagacttggaacagacaagatttgctggtcacatttaagacagctcacgcaaagaagcaggaagtggtcgtgctgggatcacaagaaggagcaatgcacactgcgttgactggggcgacggaaatccagacgtcaggaacgacaacaatctttgcaggacacctgaaatgcagactaaaaatggataaactcactttaaaagggatgtcatatgtgatgtgcacaggctcatttaagttagagaaagaagtggctgagacccagcatggaaccgtcttagtgcaggttaaatacgaaggaacagatgcaccatgcaagatacccttttcgacccaagatgagaaaggagtgacccagaatgggagattgataacagccaatcccatagttactgacaaagaaaaaccagtcaacattgagacagaaccaccttttggtgagagctacatcgtgataggggcaggtgaaaaagctttgaaactaagctggttcaagaaaggaagcagcatagggaaaatgttcgaagctaccgcccgaggagcacgaaggatggccatcttgggagacaccgcatgggacttcggttctataggaggagtgttcacatctgtaggaaaattggtacaccaggtttttggagccgcatatggggttttgtttagcggtgtttcttggaccatgaaaataggaatagggattctgctgacatggctaggattaaattcaaggagcacgtcactttcgatgacgtgcattgcagttggcatggtcacactgtacctaggagtcatggttcaagcggactcggggtgtgtaatcaactggaagggcagagaactcaaatgtggaagtggcatttttgtcactaatgaagtccacacttggacagagcaatataaattccaggctgactccccaaaaagactgtcagcagccattgggaaggcatgggaggagggcgtgtgtggaattcgatcagccacacgtcttgagaacatcatgtggaagcaaatatcaaatgaattgaaccacattctacttgaaaatgacatgaaattcacagtggttgttggagatgctaatggaatcttggcccaaggaaaaaaaatgattaggccacaacccatggaacacaaatattcatggaaaagctggggaaaagccaaaatcataggagcagacatacagaataccaccttcatcatcgatggcccagacactccagaatgccccgatgaccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtattggatagaaagtgaaaagaacgagacctggaagctagcgagagcctccttcatagaagttaagacatgcatctggccaaaatctcacactctatggagtaatggagttttggaaagtgaaatgataatcccaaagatatatggaggaccaacatctcagcacaactacagaccagggtatttcacacaaacagcagggccatggcacctaggaaagttggaattagattttgatttgtgtgaaggcaccacagttgttgtggatgaacattgtggaaatcgaggtccatctcttagaactacaacagtcacaggaaagataatccatgaatggtgctgcagatcctgcacattaccccccttacgcttcaaaggagaagacggatgttggtacggcatggaaattagaccagttaaggagaaggaagagaacctagtcaggtcaatggtctctgcagggtcaggagaagtggacagtttttcattgggactactatgcgtgtcaataatgattgaagaagtgatgagatccagatggagtagaaagatgctgatgactggaacactggctgttttcttccttctcataatggggcaactgacgtggaatgatctgatcaggttatgcatcatggttggagccaatgtttcagacaggatggggatgggaacaacgtacctagccttgatggccactttcaaaatgagaccaatgttcgctgttgggctgttatttcgcagactaacatccagagaagttcttcttcttacaattggattaagcctggtggcatccgtggagctaccaaattctttagaggagctaggggatggacttgcaatgggcatcatgatgttaaaattattgactgattttcagtcacaccagttatggactaccttactgtctctgacattcatcaaaacaactctttcattggattatgcatggaagacaatggctatggtactgtcaattgtatctctctttcctttatgtctatctacgacctctcaaaaaacaacatggcttccggtgctgttaggatcttttggatgcaaaccactaaccatgtttcttataacagaaaacaaaatctggggaaggaaaagttggcccctcaatgaaggaattatggctgttggaatagttagcattctactaagttcactcctcaaaaatgatgtgccactagctggcccactaatagctggaggcatgctaatagcatgttatgtcatatccggaagctcagccgatttatcattggagaaagctgctgaggtctcctgggaagaagaagcagaacattctggtgcctcacacaacatattagtggaggtccaagatgatggaaccatgaaaataaaagatgaagagagagatgacacgctcacaatactcctcaaagcaactctgctggcagtctcaggggtgtacccaatgtcaattccagcaaccctttttgtgtggtatttttggcagaaaaagaaacagagatcaggagtgttgtgggacacacccagccctccagaagtggaaagagcagttcttgatgatggtatctacagaatctcgcaaagaggactgttgggtaggtctcaagtaggagtgggagttttccaagacggcgtgttccacacaatgtggcacgtcaccaggggagctgtcctcatgtaccaagggaagaggctggaaccaagttgggccagtgtcaaaaaagacttgatctcatatggaggaggttggaggtttcaaggatcatggaacacgggagaagaagtgcaggtgatagctgttgaaccaggaaaaaaccccaaaaatgtacagacaacgccgggtaccttcaagacccttgaaggtgaagttggagccatagccctagatttcaaacccggcacatctggatctcccatcgtgaacagagagggaaaaatagtaggtctttatggaaatggagtggtgacaacaagtggaacctacgtcagtgctattgcccaagctaaagcatcacaagaagggcctctaccagagattgaggacgaggtgtttaggaaaagaaacttaacaataatggacctgcatccaggatcaggaaaaacaagaagatatcttccagccatagtccgtgaggccataaaaaggaaactgcgtacgctaatcttggcccccacaagagttgtcgcctctgaaatggcagaggcgcttaagggaatgccaataagatatcaaacaacagcagtaaagagtgaacacacaggaagggagatagttgacctcatgtgccacgccaccttcaccatgcgtctcctatctccagtgagagttcccaattacaacatgattatcatggatgaagcacattttaccgatccagccagcatagcggccagagggtacatctcaacccgagtgggtatgggtgaagcagctgcgatctttatgacagccacccccccaggatcggtggaggcctttccacagagcaatgcagttatccaagatgaggagagagacattcctgagagatcatggaactcaggctacgactggatcactgatttcccaggcaaaacggtctggtttgtcccaagcatcaaatcaggaaatgacattgccaactgtttaagaaagaacgggaaacgggtgatccaattgagcagaaaaacctttgacactgagtaccagaaaacaaaaaacaatgactgggactatgttgtcacaacagacatttccgaaatgggagcaaatttccgggccgacagggtaatagacccaaggcggtgcttgaaaccggtaatactaaaagatggtcctgagcgcgtcattctagccggaccgatgccagtgactgtggccagtgctgcccagaggagaggaagaattggaaggaaccaaaacaaggaaggtgatcagtatgtttacatgggacagcctttaaacaacgatgaggaccacgctcattggacagaagcaaaaatgctccttgacaatataaacacaccagaagggattatcccagccctctttgagccggagagggaaaagagtgcagcaatagacggggagtacagactgcggggagaagcaaggaaaacgttcgtggagctcatgagaagaggagatctaccagtttggctatcctacaaagttgcctcagaaggcttccagtactccgacagaaggtggtgctttgatggggaaaggaacaaccaggtgttggaggagaacatggacgtggagatctggacaaaggaaggagaaagaaagaaactacgacctcgctggttggatgccagaacatactctgatccactggcccttcgcgagtttaaagagtttgcagcaggaagaagaagtgtctcaggtgatctaatattagaaatagggaaacttccacagcatttgacgctaaaggcccagaatgctttggacaacttggtcatgttgcataattccgaacaaggaggaaaagcctatagacacgctgtggaagaactaccagacaccatagaaacattgatgctcctagctttaatagctgtgctgactggtggagtgacgctgttcttcctatcaggaaaaggtctagggaaaacatccattggcctactctgtgtgatggcctcaagcgtactgttatggatggccagtgtggagccccattggatagcggcctccatcatactagagttctttctgatggtgctactcattccagagccagacagacagcgcaccccacaggacaaccagctagcatatgtggtgataggtttgttattcatgatactgacagtggcagccaatgagatgggattactggaaaccacaaagaaagacctggggatcggccatgtagttgccgaaaaccaccaccatgctacaatgctggacatagacctacatccagcctcagcctggaccctctatgcagtagccacaacaattatcactcccatgatgagacacacaattgaaaacacaacggcaaatatttccctgacagctattgcaaatcaggcggctatattgatgggacttgacaagggatggccaatatcgaagatggacataggagttccacttctcgccttagggtgctattcccaggtgaacccattgacactgacagcagcggtgttgatgctagtggctcattatgccataatcggacctggaatgcaagcaaaagctactagagaagctcaaaaaaggacagcggccggaataatgaaaaatccaactgtagacgggattgtcgcaatagatttggatccagtggtttacgatgcaaaatttgaaaaacagctaggccaaataatgttactgatactttgcacatcacagattctcttgatgcggactacatgggccttatgtgaatccatcacactggctactggacccttgaccactctctgggagggatctccaggaaagttctggaataccacgatagcagtgtccatggcaaacatcttcaggggaagttatctagcaggagcaggtctggccttctcattaatgaaatctttaggaggaggtaggagaggtacgggagctcaaggggaaacattgggagaaaaatggaaaagacagctaaaccaactgagcaagtcagaattcaacacttacaaaaggagtgggattatggaggtggacagatccgaagccaaggagggactaaaaagaggagaaacaaccaaacatgcagtgtcgagaggaacagccaaactgaggtggtttgtggagaggaacctcgtgaaaccagaagggaaagtcatagacctcggctgtggaagaggtggctggtcatattattgcgccgggctgaagaaggtcacagaagtgaagggatacacaaaaggaggacctggacatgaggaacctatcccaatggcgacatatggatggaacctagtgaagctacactctggaaaagatgtattcttcacaccacctgagaaatgcgacacccttttgtgtgatattggtgagtcctctccgaatccaactatagaagaaggaagaacgttacgtgttctgaagatggtggaaccatggctcagaggaaaccaattttgcataaaaatcctaaatccttacatgccacgtgtggtagagactctggaacaaatgcaaagaaaacatggagggatgctagtgcgaaacccactctcaagaaattccacccatgaaatgtactgggtttcatgtggaacaggaaacattgtgtcggcagtgaacatgacatccagaatgttgctgaaccgattcacaatggctcacaggaagccaacatatgaaagagacgtggacttaggcgctggaacaagacatgtgatagtggaaccagaggtagccaacctcgatatcattggccagaggatagagaatataaaaaatgaacataagtcaacatggcattatgatgaggacaatccatacaaaacatgggcctaccatggatcatatgaggtcaagccatcaggatcagcctcatccatggtgaatggcgtggtgaaactgctcaccaaaccatgggatgttatccccatggttacgcaaatagctatgactgataccacacccttcggacaacagagggtgtttaaagagaaagttgacacgcgcacaccaagagcaaaacgaggcacagcacaaattatggaggtgacagccaagtggttatggggtttcctttctagaaacaaaaaacccagaatctgcacaagagaggagttcacaagaaaagttaggtcaaacgcagcaattggagcagtgtttgttgatgaaaaccaatggaactcagcaaaagaagcagtagaagacgaaaggttttgggatctcgtgcacagagagagggagcttcataaacagggaaagtgtgccacgtgcgtctacaacatgatgggaaaaagagagaaaaaattaggagagtttggaaaggcaaaaggaagtcgtgcaatatggtatatgtggctgggagcacgctttctagagtttgaagcccttggtttcatgaatgaagatcactggttcagtagagagaattcactcagtggagtggaaggagaaggactacacaaacttggatacatactcagagacatatcaaagattccagggggaaatatatatgcagatgacacagccggatgggacacaagaataacagaggatgatcttcagaatgaggctaaaatcactgacatcatggagcccgaacatgctctattggctacatcaatctttaagctgacctaccagaataaggtggtaagggtgcaaagaccagcaaaaagtggaaccgtgatggatgtcatatccaggcgtgaccagagaggaagtggacaggtcggaacttatggcttaaatactttcaccaacatgggggtccaactaataagacaaatggaatctgagggaatcttttcacccagcgaattggaaacccctaatctagcagagagagttctcgactggttggaaaaacatggcgtcgaaaggttgaaaagaatggcaatcagcggagatgactgcgtggtgaaaccaactgatgacaggttcgcaacagccttaacagctctgaatgacatgggaaaagtaagaaaagacataccgcaatgggaaccttcaaaaggatggaatgactggcagcaagtgcctttctgttcacaccatttccaccaactgatcatgaaggatgggagggagatagtggtgccatgccgcaaccaagatgaacttgtgggcagggccagagtatcacaaggcgccggatggagcctgagagaaaccgcttgcctaggcaagtcatatgcacaaatgtggcagctgatgtacttccacaggagagacctgagactagcggctaatgctatctgttcagccgttccagttgattgggtcccaaccagtcgcaccacctggtcaatccatgcccaccatcaatggatgacaacagaagacatgttatcagtgtggaatagggtttggatagaggaaaacccatggatggaggacaaaactcatgtatccagttgggaagatgttccatacttaggaaaaagggaagatcaatggtgcggatccttgataggcttgacagcaagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 59 - DNA, 10179 bp, Dengue virus
atgaacaaccaacggaagaagacgggtcgaccgtctttcaatatgctgaaacgcgcgagaaaccgcgtgtcaactggttcacagttggcgaagagattctcaaaaggattgctctcaggccaaggacccatgaaattggtgatggctttcatagcattcctaagatttctagccatacccccaacagcaggaattttggctagatggagctcattcaagaagaacggagcgatcaaagtgttacggggtttcaaaaaagagatctcaagcatgctgaacataatgaacaggaggaaaagatcagtgaccatgcttcttatgctgttgcccacagccctggcgtttcatttgaccacacgagggggagagccacatatggtagttagcaagcaggaaagaggaaagtcactcttgtttaagacctctgcaggtgtcaacatgtgcaccctcattgcgatggatttgggagagctatgtgaggatacaatgacctacaaatgcccccggatcactgaggcggaaccagatgacgttgactgctggtgcaatgccacagacacatgggtgacctacggaacgtgttctcaaactggcgaacaccgacgagataaacgttctgtcgcactggccccacacgtgggactgggtctagaaacaagaactgaaacatggatgtcctctgaaggcgcctggaaacaaatacaaaaagtggagacttgggccttgagacacccaggattcacggtgatagccctttttctagcacatgccataggaacatccatcacccagaaagggattattttcattctgctgatgctggtgacaccatcaatggccatgcgatgcgtgggaataggcaacagagacttcgttgaaggactgtcaggagcaacatgggtggatgtggtactggagcatggaagctgcgtcaccaccatggcaaaaaataaaccaacattggacattgaactcttgaagacggaagtcacgaaccctgccgtcttgcgcaaactgtgcattgaagctaaaatatcaaataccaccaccgattcaagatgtccaacacaaggagaagctacactggtggaagaacaagacgcgaactttgtgtgtcgacgaacgttcgtggacagaggctggggtaatggctgtggactattcggaaaaggaagcctactgacgtgtgctaagttcaagtgtgtgacaaaacttgaaggaaagatagttcaatatgaaaacttaaaatattcagtgatagtcactgtccacactggggaccagcaccaggtgggaaatgagactacagaacatggaacaattgcaaccataacacctcaagctcccacgtcggaaatacagctgaccgactacggagccctcacattggactgctcacctagaacagggctggactttaatgatatggtgctgctgacaatgaaagaaaaatcgtggcttgtccacaaacaatggtttctagacttaccattgccttggacctcgggggcttcgacatctcaagagacttggaacagacaagatttactggtcacatttaagacagctcatgcaaagaagcaggaagtagtcgtgctgggatcacaagaaggagcaatgcacactgcgctgactggggcgacggaaatccagacgtcaggaacgacaacaatcttcgcaggacacctgaaatgcagactaaaaatggataaactcactttaaaagggatgtcatatgtgatgtgcacaggctcatttaagttagagaaggaagtggctgagacccagcatggaaccgtcctagtgcaggttaaatacgaaggaacagatgcaccatgcaagatacccttttcgacccaagatgagaaaggagtgacccagaatgggagattgataacagccaatcccatagttactgacaaagaaaaaccagtcaacattgagacagaaccaccttttggtgagagctacatcgtgataggggcaggtgaaaaagctttgaaactaagctggttcaagaaaggaagcagcatagggaaaatgttcgaagctaccgcccgaggagcacgaaggatggccatcttgggagacaccgcatgggacttcggttctataggaggagtgttcacatctgtgggaaaattggtacaccaggtttttggagccgcatatggggttttgtttagcggtgtttcttggaccatgaaaataggaatagggattctgctgacatggctaggattaaattcaaggagcacgtcactttcgatgacgtgcattgcagttggcatggtcacactgtacctaggagtcacggttcaagcggactcggggtgtgtaatcaactggaagggcagagaactcaaatgtggaagtggcatttttgtcactaatgaagtccacacttggacagagcaatataaattccaggctgactccccaaaaagactgtcagcagccattgggaaggcatgggaggagggcgtgtgtggaattcgatcagccacacgtcttgagaacatcatgtggaagcaaatatcaaatgaattgaaccacattctacttgaaaatgacatgaagttcacagtggttgtaggagatgctaatggaatcttggcccaagggaaaaaaatgattaggccacaacccatggaacacaaatactcatggaaaagctggggaaaagccaaaatcataggagcagacatacataataccaccttcatcatcgatggcccagacactccagaatgccccgatgaccaaagagcatggaacatttgggaagttgaggactatgggtttggaattttcacgacaaacatatggctgaaattgcgtgactcctacacccaaatgtgtgaccaccgggtaatgtcagctgccatcaaggacagcaaggcagtccatgctgacatggggtattggatagaaagtgaaaagaacgagacctggaagctagcgagagcctctttcatagaagttaaaacatgcatctggccaaaatctcacactctatggagtaatggagttttggaaagtgaaatgataatcccaaagatatatggaggaccaacatctcagcacaactacagaccagggtatttcacacaaacagcagggccatggcacctaggcaagttggaattagattttgatttgtgtgaaggcaccacagttgttgtggatgaacattgtggaaatcgaggtccatctcttagaaccacaacagtcacaggaaagataatccatgaatggtgttgcagatcctgcacattaccccccttacgcttcaaaggagaagacggatgttggtacggcatggaaatcagaccagttaaggagaaggaagagaacctagttaggtcaatggtctctgcagggtcaggagaagtggacagtttttcattaggactactatgcgtgtcaataatgattgaagaagtgatgagatccagatggagtagaaagatgctgatgactggaacactggctgttttcttccttctcataatggggcaactgacatggaatgatctgatcaggttatgcatcatggttggagccaatgtttcagacaggatggggatgggaacaacgtacctagccttgatggccactttcaaaatgagaccaatgttcgctgttgggctattatttcgcagactaacatccagagaagttcttcttcttacaattggattaagcctggtggcatccgtggagctaccaaattctttagaggagctaggggatggacttgcaatgggcatcatgatgttaaaattattgactgattttcagtcacaccagttatggactaccttactgtctctgacatttatcaaaacaaccctttcattggattacgcatggaagacaatggctatggtactgtcaatcgtatctctctttcctttatgtctatctacgacctctcaaaaaacaacatggcttccggtgctgttaggatcttttggatgcaaaccactaaccatgtttcttataacagaaaacaaaatctggggaaggaaaagttggcccctcaatgaaggaattatggctgttggaatagttagcattctactaagttcactcctcaaaaatgatgtgccactagctggcccactaatagctggaggcatgctaatagcatgttatgtcatatccggaagctcagccgatttatcattggaaaaagctgctgaggtctcctgggaagaagaagcagaacactctggtgcctcacacaacatattagtggaggtccaagatgatggaaccatgaaaataaaagatgaagagagagatgacacgctcacaatactcctcaaagcaactctgctggcagtctcaggggtgtacccaatgtcaattccagcgaccctttttgtgtggtatttttggcagaaaaagaaacagagatcaggagtgttgtgggacacacccagccctccagaagtggaaagagcagttcttgatgatggtatctacagaatcttgcaaagaggactgttgggtaggtcccaagtaggagtgggagttttccaagacggcgtgttccacacaatgtggcacgtcactaggggagctgtcctcatgtaccaagggaagaggctggaaccaagttgggccagtgtcaaaaaagacttgatctcatatggaggaggttggaggtttcaaggatcatggaacacgggagaagaagtgcaggtgatagctgttgaaccaggaaaaaaccccaaaaatgtacagacaacgccgggtaccttcaagacccctgaaggtgaagttggagccatagccctagatttcaaacccggcacatctggatctcccatcgtgaacagagagggaaaaatagtaggtctttatggaaatggagtggtgacaacaagtggaacctacgtcagtgctattgcccaagctaaagcatcacaagaagggcccctaccagaaattgaggacgaggtgtttaggaaaagaaacttaacaataatggacctgcatccaggatcaggaaaaacaagaagatatcttccagccatagtccgtgaggccataaaaaggaaactgcgcacgctaatcttggcccccacaagagttgtcgcctctgaaatggcagaggcgcttaagggaatgccaataagatatcaaacaacagcagtaaagagtgaacacacaggaagggagatagttgacctcatgtgccacgccactttcaccatgcgtctcctatctccagtgagagttcccaattacaacatgattatcatggatgaagcacattttaccgatccagctagcatagcggccagagggtacatctcaacccgagtgggtatgggtgaagcagctgcgatctttatgacagccacccccccaggatcggtggaggcctttccacagagcaatgcagttatccaagatgaggaaagagacattcctgagagatcatggaactcaggctacgactggatcactgattttccaggtaaaacagtctggtttgtcccaagcatcaaatcaggaaatgacattgccaactgtttaagaaagaacgggaaacgggtgatccaattgagcagaaaaacctttgacactgagtaccagaaaacaaaaaacaatgactgggactatgttgtcacaacagacatttccgaaatgggagcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaacaatgatgaggaccacgctcattggacagaagcaaaaatgctccttgacaatataaacacaccagaagggattatcccagccctctttgagccagagagggaaaagagtgcagcaatagacggggagtacagactgcggggagaagcaaggaaaacgttcgtggagctcatgagaagaggagatctaccagtttggctatcctacaaagttgcctcagaaggcttccagtactccgacagaaggtggtgctttgatggggaaaggaacaaccaagtgttggaggagaacatggacgtggagatctggacaaaggaaggagaaagaaagaaactacgacctcgctggttggatgccagaacatactctgatccactggcccttcgcgagtttaaagagtttgcagcaggaagaagaagtgtctcaggtgacctaatattagaaatagggaaacttccacagcatttgacgctaaaggcccagaatgctttggacaacttggtcatgttgcataattccgaacaaggaggaaaagcctatagacatgctatggaagaactaccagacaccatagaaacattgatgctcctagctttgatagctgtgctgactggtggagtgacgctgttcttcctatcaggaagaggtctagggaaaacatccattggcctactctgtgtgatggcctcaagcgtactgttatggatggccagtgtggagccccattggatagcggcctccatcatactagagttctttctgatggtgctgctcattccagagccagacagacagcgcaccccacaggacaaccagctagcatatgtggtgataggtttgttattcatgatactgacagtggcagccaatgagatgggattactggaaaccacaaagaaagacctggggatcggccatgtagttgccgaaaaccaccaccatgctacaatgctggacatagacctacatccagcctcagcctggaccctctatgcagtagccacaacaattatcactcccatgatgagacacacaattgaaaacacaacggcaaatatttccctgacagctattgcaaatcaggcggctatattgatgggacttgacaagggatggccaatatcgaagatggacataggagttccacttctcgccttagggtgctattcccaggtgaacccattgacactgacagcagcggtgttgatgctagtggctcattatgccataatcggacctggactgcaagcaaaagccactagagaagctcaaaaaaggacagcggccggaataatgaaaaatccaactgtagacgggattgtcgcaatagatttggatccagtggtttacgatgcaaaatttgaaaaacagctaggccaaataatgttactgatactttgcacatcacagattctcttgatgcggactacatgggccttatgtgaatccatcacactggctactggacccctgaccactctctgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactgggagaaaaatggaaaagacagctaaaccaactgagcaagtcagaattcaacacttacaaaaggagtgggattatggaggtggatagatccgaagccaaggagggactaaaaagaggagaaacaaccaaacatgcagtgtcgagaggaacagctaaactgaggtggtttgtggagaggaacctcgtgaaaccagaagggaaagtcatagacctcggctgtggaagaggtggctggtcatattattgcgccgggctgaagaaggtcacagaagtgaagggatacacaaaaggaggacctggacatgaggaacctatcccaatggcaacatatggatggaacctagtgaagctacactctggaaaagatgtattcttcacaccacctgagaaatgtgatacccttttgtgtgatattggtgagtcctctccgaatccaactatagaagaaggaagaacgttacgtgttctgaagatggtggaaccatggctcagaggaaaccaattttgcataaaaatcctaaatccttacatgccaagtgtggtagagactctggaacaaatgcaaagaaaacatggagggatgctagtgcgaaacccactctcaagaaattccacccatgaaatgtactgggtttcatgtggaacaggaaacattgtgtcggcagtgaacatgacatccagaatgttgctgaaccgattcacaatggctcacaggaagccaacatatgaaagagatgtggacttaggcgctggaacaagacatgtgacagtggaaccagaggtagccaacctggatatcattggccagaggatagagaatataaaaaatgaacataagtcaacatggcattatgatgaggacaatccatacaaaacatgggcctatcatggatcatatgaggtcaagccatcaggatcagcctcatccatggtgaatggcgtggtgagactgctcaccaaaccatgggatgtcatccccatggttacacaaatagctatgactgacaccacacccttcggacaacagagggtgtttaaagagaaagttgacacgcgcacaccaagagcaaaacgaggcacagcacaaattatggaagtgacagccaagtggttatggggtttcctttctagaaacaaaaaacccagaatctgcacaagagaggagttcacaagaaaagttaggtcaaacgcggctattggagcagtgtttgttgatgaaaaccaatggaactcagcaaaagaagcagtggaagacgaaaggttctgggatctcgtgcacagagagagggagcttcataaacagggaaaatgtgccacgtgcgtctacaacatgatgggaaaaagagagaaaaaattaggagagtttggaaaagcaaaaggaagtcgtgcaatatggtatatgtggctgggagcacgctttctagagttcgaagcccttggcttcatgaatgaagatcactggttcagtagagagaattcactcagtggagtggaaggagaaggactacacaaacttggatacatactcagagacatatcaaagattccagggggaaatatgtatgcagatgacacagccggatgggacacaagaataacagaggatgatcttcagaatgaggctaaaatcactgacatcatggagcctgaacatgctctattggctacgtcaatctttaagctgacctaccaaaataaggtggtaagggtgcaaagaccagcaaaaagtggaaccgtgatggatgtcatatctagacgtgaccagagaggaagtggacaggtcggaacttatggcttaaatactttcaccaacatggaggtccaactaataagacaaatggaatctgagggaatcttttcacccagcgaattggaaacccctaatctagcagagagagttctcgactggttggaaaaacatggcgtcgaaaggttgaaaagaatggcaatcagcggagatgactgcgtggtgaaaccaactgatgacaggttcgcaacagccttaacagctctgaatgacatgggaaaagtaagaaaagacataccgcaatgggaaccttcaaaaggatggaatgactggcagcaagtgcctttctgttcacaccatttccaccaactgatcatgaaggatgggagggagatagtggtgccatgccgcaaccaagatgaacttgtgggcagggcaagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcaccacctggtcaatccatgcccaccatcaatggatgacaacagaagacatgttatcagtgtggaatagggtttggatagaggaaaacccatggatggaagacaaaactcatgtatccagttgggaggatgttccatacttaggaaaaagggaagatcaatggtgtggatccttgataggcttgacagcaagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 60 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggccttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatctgggagagttatgtgaggacacaatgacttacaaatgccctcgaatcactgaggcagaaccagatgacgttgattgttggtgcaatgccacagactcatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaacggctgtgggctcttcggaaaaggaagcctaataacgtgtgctaagttcaagtgtgtgacaaaactggaaggaaagatagtccaatatgaaaacttgaaatattcagtaatagtcaccgtccacactggagaccagcaccaggtgggaaatgaaagcacagaacatgggacaactgcaactataacacctcaagctcctacaacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaaaatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacactgcatgggactttggttctataggaggagtgttcacgtctgttggaaaattggtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagtggcatttttgtcactaatgaagttcacacttggacagaacaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggattttggctcaagggaaaaagatgattaggccacaacccatggaatacaaatactcgtggaaaaactggggaaaggctaaaatcataggggcagatgtacagaacgccaccttcatcatcgacggcccaaacaccccagaatgtcctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggatactggatagaaagtgaaaagaacgagacctggaagctggtaagagcctctttcatagaagttaaaacatgtgtctggccaaaatcccacactctatggagcaatggagttctggaaagtgaaatgataattccaaagatctatggaggaccaatatcccagcacaactacagaccaggatatttcacacaaacggcagggccgtggcacctaggcaagttggaactggattttgatttgtgtgagggtaccacagttgttgtggatgaacattgtggaaatcgaggaccatcttttaggaccaaaacagtcacaggaaagataattcatgaatggtgttgcagatcttgtacgctaccacccttacgtttcagaggagaagatgggtgctggtacggtatggaaatcagaccagtcaaggaaaaggaagagaacctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccagcgcttccgacaggatggggatgggaacgacgtacctagctctgatggccacatttaaaatgagaccaatgtttgctgtagggctattattccgcagactaacatccagagaagttcttcttctaacaattggactgagtctagtggcatctgtggagttaccaaattccttggaggagctgggggatggacttgcaatgggcattatgattttaaaattattgactgactttcaatcacatcagctgtgggctaccctgctgtccttgacatttatcaaaacaacgttttccttgcactacgcatggaagacaatggctatggtactgtcaattgtatctctcttccccttatgcctatctacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctaaaaaatgatgtgccgctagctgggccactaatagctggaggcatgctaatagcatgttatgttatatctggaagctcagccgatctatcactagagaaagcggccgaggtctcctgggaagaagaagcagaacactctggtgcctcacacaacatattagtggaggtccaagatgatggaaccatgaagataaaggatgaagagagagatgacacgctaaccattctcctcaaagcaactctcctagcagtttcaggggtgtacccattatcaataccagcgaccctttttgtgtggtacttttggcagaaaaagaagcagagatctggagtgttatgggacacacctagccctccaaaagtggaaagagcagttcttgatgatggtatttatagaattatgcagagaggactgttgggcaggtcccaagtaggggtaggagtttttcaagaaaacgtgttccacacaatgtggcatgtcaccaggggagctgtactcatgtatcaagggaagagactggagccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccaggcacctttaagacccctgaaggtgaagttggagctattgccctagattttaaacccggcacatctggatctcccatcgtgaacagagaaggaaaaatagtaggtctttatggaaatggagtagtgacaacaagtggaacctacgtcagcgccatagctcaagctaaagcatcacaagaagggcccctaccagagattgaagacgaggtgtttaggaagagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtcttccgtgagagttcccaattacaacatgattatcatggatgaagcacatttcaccgatccatccagcatagcggccagagggtacatctcaacccgagtgggcatgggtgaagcaactgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatggaaaacgggtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgttattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacttttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctgatattagaaatagggaaacttccacaacatttgacgcaaagggcccagaatgccttggacaacctggttatgttgcacaactccgaacaaggaggaagagcctatagacatgcactggaagaactgccagacaccatagaaacgttgatgctcctagctttgatagctgtgttaactggtggagtgacgctgttcttcctatcaggaaggggcctagggaaaacatccattggcctactctgcgtgatggcttcaagcgcactgctatggatggccagtgtggagccccattggatagcggcctccatcatactggagttcttcctgatggtgctgctcattccagagccagacagacaacgcactccgcaggacaaccagctggcatatgtggtgataggtctgttattcatgatactgacagtagcagccaatgagatgggactgctggaaaccacaaagaaagacttagggattggccatgtggctgttgaaaatcaccaccatgcctcaatgctggacgtagacttacacccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccattgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccaaagccaaagagggacttaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacacccttttatgtgatattggtgagtcctctccaaacccaactatagaggaaggaagaacgctacgcgtcctaaagatggtggaaccatggcttagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatccagaatgttgttaaatcgattcacaatggctcacaggaaaccaacatatgaaagagatgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacccaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaaccaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaagtcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaattagcggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaagtagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacttgagactagccgctaacgctatctgttcagccgttccagttgattgggtcccaaccagccgcaccacctggtcgatccatgcccaccaccagtggatgacaacagaagacatgctgtcagtgtggaatagggtttggatagaggaaaacccatggatggaggacaaaacccatatatccagttgggaagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaaaaacgagagtgatcccgaaggggcactctggtga

SEQ ID NO: 61 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgattaaagtgttacggggtttcaagaaagaaatctcaaacatgttgaatataatgaatagaaggaagagatccgtgaccatgctccttatgctgctgcccacaaccttggcgtttcatctgaccacacgagggggagagccgcatatgatagttaccaagcaggaaagaggaaagtcacttttatttaagacctcagctggtgtcaacatgtgcacccttattgcaatggatttgggagagttatgtgaggacacaatgacttacaaatgtcctcgaatcactgaggcggaaccagatgacgttgattgttggtgcaatgccactgacacatgggtgacctatggaacatgttcccaaactggcgaacaccgacgagacaaacgttccgtcgcactggctccacacgtgggacttggtctagaaacaagaaccgaaacgtggatgtcctctgaaggcgcttggaaacaaatacaaagagtggagacttgggccctgagacacccaggattcacagtgatagccctttttctagcacatgccataggaacatccatcacccagaaagggattattttcattttgttgatgctggtaacaccatccatggccatgcgatgtgtgggaataggcaacagggacttcgtggaaggactgtcaggagcaacgtgggtagatgtggtactggaacatggaagttgtgtcaccaccatggcaaaagataaaccaaccttggacattgaactcttgaagacggaagtcacaaaccctgccgtcctgctcaaactgtgcattgaaactaaaatatcaaacaccaccaccgactcaagatgtccaacacaaggagaggccacactggtggaagaacaggacgcgaattttgtgtgtcgacgaacgtttgtggacagaggctggggcaatggctgtgggctttttggaaaaggtagcctactaacgtgtgctaagttcaagtgtgtgacaaaactggaaggaaagatagttcaatacgaaaacttgaaatatacagtaatagtcactgtccacactggagaccagcaccaggtgggaaatgaaagcacagaacatggaacaacagcaactataacacctcaagctcccacgtcggaaatacagctgaccgactacggagctcttacattggattgctcacctagaacaggactagacttcaatgaaatggtgttgttgacaatgaaagaaaaatcatggctagtccacaaacaatggtttctagacctaccactgccttggacctcgggagctacaacgtcacaagagacttggaacagacaagatttgctggtaacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaaaatggacaaactgactctaaaagggatgtcatatgtgatgtgcacaggctcattcaagctagagaaagaggtggctgagacccagcatggaaccattctagtgcaggttaaatacgaaggaacagatgcaccatgcaagatccctttttcgacccaagatgaaaaaggagtaacccagaatgggagagtgataacagccaaccccatagtcactgacaaggaaaaaccagtcaacattgaggcagaaccaccttttggtgagagttacatcgtggtaggagcaggtgaaaaagctttgaaactaagctggttcaagaaaggaagcaccatagggaaaatgtttgaggcaaccgcccgaggagcacgaaggatggccatactgggagacaccgcatgggactttggttccataggaggagtgttcacatctgttggaaaactagtacaccagatttttggaactgcatatggagttttgttcagcggtgtttcctggaccatgaaaataggaataggggttctgctgacatggctaggattaaactcaaggagcacgtctctttcgatgacgtgcattgcagttggcctggtaacactgtacctaggagtcatggttcaggcggattcaggatgtgtaattaactggaaaggcagagaactcaaatgtggaagtggcatttttgtcaccaatgaagttcacacttggacagagcaatacaaatttcaggctgactccccaaagagactatcagcagccatcgggaaggcatgggaggagggtgtgtgtggaattcgatcagccactcgtctcgagaatatcatgtggaagcaaatatcaaatgaactgaaccacattttacttgaaaatgacatgaaattcacagtggttgtaggagatgttagtgggatcttggcccaagggaaaaaaatgattaggccacaacccatggaatacaaatactcgtggaaaagctggggaaaagctaaaatcataggggcagatgtacagaactccaccttcatcattgacggcccaaacaccccagaatgccccgatgatcaaagagcatggaacatttgggaagttgaggactatggatttggaattttcacaacaaacatatggttgaaattgcgtgactcctacacccaagtgtgtgaccaccggctaatgtcagctgccatcaaggacagcaaggcagttcatgctgacatggggtactggatagaaagtgaaaagaacgagacttggaagctggcaagagcctcctttatagaagttaaaacatgcgtttggccaaaatcccacactctatggagcaatggagttctggaaagtgaaatgataattccaaagatatatggaggaccaatatctcagcacaactacagaccaggatatttcacacaaacagcagggccgtggcacctaggcaagttggaactggattttaatttgtgtgagggtaccacagttgttgtggatgaacattgtggaaatcgaggaccatctcttagaaccacaacagtcacaggaaaaataatccatgaatggtgctgcagatcttgtacgctaccacccttacgtttcaaaggagaagatgggtgttggtatggtatggaaattagaccagtcaaggaaaaggaagagaatctagtcaaatcaatggtctctgcagggtccggagaagtggacagcttttcactaggactgctatgcatatcaataatgaccgaagaggtgatgagatctagatggagtagaaaaatgctgatgactggaacactggctgtgttcctccttctcataatgggacaattgacatggaatgatctgatcaggttatgcatcatggttggagccaatgcttcagacaggatggggatgggaacaacgtacctagctctgatggccacttttaaaatgagaccaatgtttgctgtcgggctattattccgcagactaacatctagagaagttcttcttcttacaattggattgagtctagtggcatccgtggagctaccaaattctttggaggagctgggggatggacttgcaatgggcattatgatcttaaaattactgactgactttcaatcacatcagctgtgggctgccttgctatccctgacatttattaaaacaactttttctttgcactatgcatggaagacaatggctatggtactgtcaattgtgtctctcttccccttatgcctgtccacgacctctcaaaaaacaacatggcttccggtgctattgggatctcttggatgcaaaccactaaccatgtttctcatagcagaaaacaaaatttggggaaggaaaagttggcctctcaatgaaggaatcatggctgttggaatagtcagcatcttactaagctcactcctcaagaatgatgtgccgctagctgggccactaatagctggaggcatgctaatagcatgttatgttatatctggaagttcagccgatttatcattagagaaagcggctgaggtctcctgggaagaagaagcagaacactctggtgcctcacacaacatattagtggaggtccaagatgatggaaccatgaagataaaagatgaagagagagatgacacactaaccattctccttaaagcaactttgctggcagtttcagggatgtacccattatcaataccagcgaccctttttgtgtggtatttttggcagaaaaagaaacagagatcaggagtgttgtgggacacacctagccctccagaagtagaaagagcagttcttgatgatggtatctatagaattatgcagagaggactgttgggcagatcccaagtaggggtaggagttttccaagaaaacgtgttccacacaatgtggcatgtcaccaggggagctgtactcatgtatcaagggaagagactggaaccaagttgggctagtgtcaaaaaagacctgatctcatatggaggaggctggaggcttcaaggatcctggaacacgggagaagaagtgcaggtgatcgctgttgaaccaggaaaaaaccccaaaaatgtacagacagcgccgggcaccttcaagacccctgaaggtgaagttggagccatagccctagattttaaacccggcacatctggatcccccatcgtgaacagagaggggaaaatagtaggtctttatggaaatggagtagtgacaacaagtggaacctacgttagtgccatagctcaagctaaagcatcacaagaagggcccctaccagagattgaggacgaggtgtttaggaaaagaaacttaacaataatggacctacatccaggatcgggaaaaacaagaagatatcttccagccatagtccgtgaggccataaaaaggaagctgcgcacactaattttggctcccacaagagttgtcgcttccgaaatggcagaggcgctcaaaggaatgccgataaggtatcagacaacagcagtgaagagtgaacacacaggaaaagagatagttgacctcatgtgccacgccactttcactatgcgtctcctgtctcccgtgagagttcccaattacaacatgattattatggatgaagcacatttcacagatccatccagcatagcggccagagggtacatctcaacccgagtgggtatgggtgaagcagctgcgatcttcatgacagccactcccccaggatcggtggaggcctttccacagagtaatgcagttatccaagatgaggaaagagacattcctgagagatcatggaactcaggctatgactggatcactgacttcccaggtaaaacggtctggtttgttccaagcatcaaatcaggaaatgacattgccaactgtttaagaaagaatgggaaacgggtgattcaattgagtaggaaaacctttgacacagagtaccaaaagacaaaaaacaacgactgggactatgtcgtcacaacagacatctccgaaatgggagctaacttccgagccgacagggtaatagacccaagacggtgtctgaaaccggtaatactaaaagatggtccagagcgtgtcattctagcaggaccgatgccagtgactgtggccagtgccgcccagaggagaggaagaatcggaaggaaccaaaataaggaaggtgatcagtacatctacatgggacagcctttaaataacgatgaagaccacgcccattggacagaagcaaaaatgctccttgataatataaacacaccagaagggattatcccagccctctttgagccagagagagaaaagagtgcggcaatagacggggaatatagactgcggggtgaagcaaggaaaacgtttgtggagctcatgagaagaggggatctacctgtctggctatcctacaaagttgcctcagaaggcttccagtactctgacagaagatggtgctttgatggggaaaggaacaatcaggtgctggaggagaacatggacgtggagatctggacaaaagaaggagaaagaaagaaactacgaccccgctggctggatgccagaacatactcagacccattggccctgcgcgagttcaaagagtttgcggcaggaagaagaagcgtctcaggtgatctaatattagaaatagggaaacttccacaacacttgacgcaaagggcccagaacgccttggacaacctggtcatgttgcacaactctgaacaaggaggaagagcctacagacatgcaatggaagaactcccagacaccatagaaacgttgatgctcctagctttgatagctgtgttaactggtggggtgacgttgttttttctatcaggaaggggcttagggaaaacatctatcggcctactctgcgtgatggcttcaagcgtgctgttatggatggccagtgtggagccccattggatagcggcctccatcatactagaattctttctgatggtgctgcttattccagagccagacagacaacgcactccacaggacaaccagttggcatatgtagtgataggtttgttattcatgatactgacagtagcagccaatgagatgggattactggaaaccacaaagaaagacttagggattggccatgtggctgttgaaaatcaccaccatgccacaatgttggacgtagacttacatccagcttcagcctggaccctctatgcagtggccacaacaattatcactcccatgatgaggcacacaatcgaaaacacaacggcaaatatttccctgacagctattgcaaaccaggcagccatattgatgggactcgacaaaggatggccaatatcgaagatggacataggagttccacttctcgccttggggtgctattcccaggtgaatccactgacgctgacagcggcagtattgatgctagtggctcattatgccataattggacctggactgcaagcaaaagctactagagaagcccaaaaaaggacagcggctggaataatgaagaatccaactgtcgatggaataattgcaatagatttggaccctgtggtttatgatgcaaaatttgagaaacaactaggccaaataatgttgttgatactatgcacatcacagatcctcttgatgcggactacatgggccttgtgtgaatccatcacactggctactggacctctgaccacgctttgggaaggatctccaggaaaattttggaacaccacgatagccgtgtccatggcaaacatattcaggggaagttatctagcaggagcaggcctggccttctcactaatgaaatctctaggaggaggtaggagaggcacgggagcccaaggggaaacactgggagaaaaatggaaaagacagctaaaccaactgagcaaatcagaatttaacacttacaaaaggagtgggattatagaagtggatagatccgaagccaaagagggactgaaaagaggagaaataaccaaacatgcagtgtcgagaggaaccgccaaactgaggtggtttgtggagaggaaccttgtgaaaccagaagggaaagtcatagacctcggttgtggaagaggtggctggtcatattattgcgccgggctgaagaaagtcacagaagtgaagggatacacaaaaggaggacctggacatgaagaaccaatcccaatggcgacctatggatggaacctagtaaagctgtactctgggaaagacgtattctttacaccacctgagaaatgtgatacccttttgtgtgatattggtgagtcctctccgaatccaaccatagaagaaggaagaacgttacgtgttctgaagatggtggaaccatggctcagaggaaaccaattttgcataaaaatcttaaatccttacatgccaagtgtggtagagactctggagcaaatgcaaagaaaacatggagggatgctagtgcgaaacccactctcaagaaattccacccatgaaatgtactgggtttcatgtggaacaggaaacattgtgtcagcagtgaacatgacatccagaatgttgctgaaccgattcacaatggctcacaggaaaccaacatatgaaaaagacgtggacttaggcgctggaacaagacatgtggcagtggaaccagaggtagccaacctagatatcattggccagaggatagagaacataaaacatgaacataagtcaacatggcattatgatgaggacaatccatacaagacatgggcctatcatggatcatatgaggtcaagccatcaggatcagcctcatccatggtcaatggcgtggtgagactgctcaccaaaccatgggatgtcattcccatggtcacacaaatagccatgactgacaccacaccctttggacaacagagggtgtttaaagagaaagttgacacgcgcacaccaaaagcaaaacaaggcacagcacaaatcatggaagtgacagctagatggttatggggttttctttctagaaacaaaaaaccaagaatctgcacaagagaggagttcacaagaaaagttaggtcaaacgcagctattggagcagtgttcgttgatgaaaatcaatggaactctgcaaaagaagcagtggaagatgaacggttttgggaccttgtgcacagagagagggagcttcacaaacagggaaagtgcgccacgtgtgtttacaatatgatggggaagagagagaaaaaactaggagagttcggaaaggcaaaaggaagtcgtgcaatatggtacatgtggttgggagcacgctttctagagtttgaagcccttggtttcatgaacgaagatcactggttcagtagagagaattcactcagtggagtggaaggagaaggactccatagactcggatatatactcagagacatatcaaagattccagggggaaatatgtatgcagatgacacagccggatgggacacaaggataacagaggatgatcttcagaatgaggccaaaatcactgacatcatggagcccgaacatgccctactggctacgtcaatcttcaagctgacctaccaaaataaggtggtgagggtgcagagaccagcaaaaaatggaaccgtgatggatgttatatccagacgtgatcagagaggaagtggccaggtcggaacttatggcttaaacactttcaccaatatgggggcccagctaataagacaaatggagtctgagggaatcttttcacccagcgaattagagaccccaaatttggccgagagagttctcgactggttagaaaagtatggcgtcgaaaggctgaaaagaatggcaatcagcggagatgactgcgtggtgaaaccaattgatgacaggtttgcaacagccctaacagctctgaacgacatgggaaaagtaagaaaagacataccacaatgggaaccttcaaaaggatggaatgactggcaacaagtgcctttttgttcacaccatttccaccagctaattatgaaggatgggagggaaatagtggtgccatgccgcaatcaagatgaactcgtgggtagggctagagtgtcacaaggtgccggatggagcctgagagaaactgcatgcctgggcaagtcatatgcacaaatgtggcagctgatgtacttccacaggagagacctgagactagctgctaatgccatctgctcggccgttccagttgattgggtcccaaccagccgcaccacttggtcgatccacgcccatcatcaatggatgacaacagaaaacatgttgtcagtgtggaatagggtttggatagaggaaaacccatggatggaggacaaaacccatgtatccagctgggaagatgttccatacttaggaaaaagggaagatcagtggtgtggttccctgataggtttaacagcaagggccacctgggccaccaacatacaagtggccataaaccaagtgagaaggctaattgggaatgagaattatctagattacatgacatcaatgaagagattcaagaacgagagcgatcccgaaggggcactctggtga

SEQ ID NO: 62 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgattaaagtgttacggggtttcaagaaagaaatctcaaacatgttgaatataatgaatagaaggaagagatcagtgaccatgctccttatgctgctgcccacaaccttggcgtttcatctgaccacacgagggggagagccgcatatgatagttaccaagcaggaaagaggaaagtcacttttgtttaagacctcagctggtgtcaacatgtgcacccttattgcaatggacttgggagagttatgtgaggacacaatgacttacaaatgtcctcgaatcactgaggcggaaccagatgacgttgattgttggtgcaatgccactgacacatgggtgacctatggaacatgttctcaaactggcgaacaccgacgagacaaacgttccgtcgcactggctccacacgtgggacttggtctagaaacaagaaccgaaacgtggatgtcctctgaaggcgcctggaaacaaatacaaagagtggagacttgggccctgagacacccaggattcacagtgatagccctttttttagcacatgccataggaacatccatcacccagaaagggattatcttcattttgttgatgctggtaacaccatccatggccatgcgatgtgtgggagtaggcaacagggacttcgtggaaggactgtcaggagcaacgtgggtggatgtggtactggaacatggaagttgtgtcaccaccatggcaaaagataaaccaacattggacattgaactcttgaagacggaagtcacaaaccctgccgtcctgcgcaaactgtgcattgaagctaaaatatcaaacaccaccaccgactcaagatgtccaacacaaggagaggccacactggtggaagaacaagacgcgaattttgtgtgccgacgaacgtttgtggacagaggctggggcaatggctgtggactttttggaaaaggtagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatggaacaacagcaactataacgcctcaagctcccacgtcggaaatacagctgaccgactacggagctcttacattggattgctcacctagaacaggactagacttcaatgaaatggtgttgttgacaatgaaagaaaaatcatggctagtccacaaacaatggtttctagacctaccactgccttggacctcgggagctacaacgtcacaagagacttggaacagacaagatttgctggtaacattcaagacagctcatgcaaagaagcaggaagtggtcgtactaggatcacaagaaggagcaatgcacactgcgttgaccggagcgacagaaatccaaacgtctggaacgacaacaatttttgcaggacacttgaaatgtagactaaaaatggacaaactgactctaaaagggatgtcatatgtgatgtgcacaggcccattcaagctagagaaagaggtggctgagacccagcatggaaccgttctagtgcaggttaaatacgaaggaacagatgcaccatgcaagatccctttttcgacccaagatgaaaaaggagtaacccagaatgggagagtgataacagccaaccctatagtcactgacaaggaaaaaccagtcaacattgaggcagaaccaccttttggtgagagttacatcgtggtaggagctggtgagaaagctttgaaactaagctggttcaagaaaggaagtaccatagggaaaatgtttgaggcaaccgcccgaggagcacgaaggatggccatactgggagacaccgcatgggactttggttccataggaggagtgttcacatctgttggaaaactagtacaccagatttttggaactgcatatggagttttgttcagcggtgtttcctggaccatgaaaataggaataggggttctgctgacatggctaggattaaactcaaggagcacgtctctttcgatgacgtgcattgcagttggcctggtaacactgtacctaggagtcatggttcaggcggattcaggatgtgtaattaactggaaaggcagagaactcaaatgtggaagtggcatttttgtcaccaatgaagttcacacttggacagagcaatacaaatttcaggctgactccccaaagagactatcagcagccatcgggaaggcatgggaggagggtgtgtgtggaattcgatcagccactcgtctcgagaatatcatgtggaagcaaatatcaaatgaactgaaccacattttacttgaaaatgacatgaaattcacagtggttgtaggagatgttagtgggatcttggcccaagggaaaaaaatgattaggccacaacccatggaatacaaatactcgtggaaaagctggggaaaagctaaaatcataggggcagatgtacagaactccaccttcatcattgacggcccaaacaccccagaatgccccgatgatcaaagagcatggaacatttgggaagttgaggactatggatttggaattttcacgacaaacatatggttgaaattgcgtgactcctacacccaagtgtgtgaccaccggttaatgtcagctgccatcaaggacagcaaggcagttcatgctgacatggggtactggatagaaagtgaaaggaacgagacttggaagctggcaagagcctccttcatagaagttaaaacatgcgtttggccaaaatcccacactctatggagcaatggagttctggaaagtgaaatgataattccaaagatatatggaggaccaatatctcagcacaactacagaccaggatatttcacacaaacagcagggccgtggcacctaggcaagttggaactagattttaatttgtgtgagggtaccacagttgttgtggatgaacattgtggaaatcgaggaccatctcttagaaccacaacagtcacaggaaaaataatccatgaatggtgctgcagatcttgtacgctaccacccttacgtttcaaaggagaagatgggtgttggtatggtatggaaattagaccagtcaaggaaaaggaagagaatctagtcaaatcaatggtctctgcagggtccggagaagtggacagcttttcactaggactgctatgcatatcaataatgaccgaagaggtgatgagatctagatggagtagaaaaatgctgatgactggaacgctggctgtgttcctccttctcataatgggacaattgacatggaatgatctgatcaggttatgcatcatggttggagccaatgcttcagacaggatggggatgggaacaacgtacctagctctgatggccacttttaaaatgagaccaatgtttgctgtcgggctgttattccgcagactaacatctagagaagttcttcttcttacaattggattgagtctagtggcatccgtggagctaccaaattccttggaggaactgggggatggacttgcaatgggcattatgatcttaaaattactgactgactttcaatcacatcagctgtgggctgccttgctgtccctgacatttattaaaacaactttttctttgcattatgcatggaagacaatggctatggtactgtcaattgtgtctctcttccccttatgcctgtccacgacctctcaaaaaacaacatggcttccggtgctattgggatctcttggatgcaaaccactaaccatgtttctcatagtagaaaacaaaatttggggaaggaaaagttggcctctcaatgaaggaatcatggctgttggaatagtcagcatcttactaagctcactcctcaagaatgacgtgccgctagctgggccactaatagctggaggcatgctaatagcatgttatgttatatctggaagctcagccgatttatcattagagaaagcggctgaggtctcctgggaagaagaagcagaacactctggtgcctcacacaatatattagtggaggtccaagatgatggaaccatgaagataaaagatgaagagagagatgacacactaaccattctccttaaagcaactttgctggcagtttcagggatgtacccattatcaataccagcgaccctttttgtgtggtatttttggcagaagaagaaacagagatcaggagtgttatgggacacacctagccctccagaagtggaaagagcagttcttgatgatggtatctatagaattatgcagagaggactgttgggcagatcccaagtaggggtaggagttttccaagaaaacgtgttccacacaatgtggcatgtcaccaggggagctgtactcatgtatcaagggaagagactggaaccaagttgggctagtgtcaaaaaagacctgatctcatatggaggaggttggaggcttcaaggatcctggaacacgggagaagaagtgcaggtgatcgctgttgaaccaggaaaaaaccccaaaaatgtacagacagcgccgggcaccttcaagacccctgaaggtgaagttggagccatagccctagattttaaacccggcacatctggatcccccatcgtgaacagagaggggaaaatagtaggtctttatggaaatggagtagtgacaacaagcggaacctacgtcagtgccatagctcaagctaaagcatcacaagaagggcccctaccagagattgaggacgaggtgtttaggaaaagaaacttaacaataatggacctacatccaggatcgggaaaaacaagaagatatcttccagccatagtccgtgaggccataaaaaggaagctgcgcacactaattttggctcccacaagagttgtcgcttccgaaatggcagaggcgctcaaaggaatgccgataaggtatcagacaacagcagtgaagagtgaacacacaggaaaagagatagttgacctcatgtgccacgccactttcactatgcgtctcctgtctcccgtgagagttcccaattacaacatgattatcatggatgaagcacatttcaccgatccatccagcatagcggccagagggtacatctcaacccgagtgggtatgggtgaagcagctgcgatcttcatgacagccactcccccaggatcggtggaggcctttccacagagtaatgcagttatccaagatgaggaaagagacattcctgagagatcgtggaactcaggctatgactggatcactgacttcccaggtaaaacggtctggtttgttccaagcatcaaatcaggaaatgacattgccaactgcttaagaaagaatgggaaacgggtgattcaattgagcaggaaaacctttgacacagagtaccaaaagacaaaaaacaacgactgggactatgtcgtcacaacagacatctccgaaatgggagctaacttccgagccgacagggtaatagacccaagacggtgtctgaaaccggtaatactaaaagatggtccagagcgtgtcattctagcaggaccgatgccagtgactgtggccagtgccgcccagaggagaggaagaatcggaaggaaccaaaacaaggaaggtgatcagtacatctacatgggacagcctttaaataacgatgaagaccacgctcattggacagaagcaaaaatgctccttgataatataaacacaccagaagggataatcccagccctctttgaaccggagagagaaaagagtgcggcaatagacggggaatatagactgcggggtgaagcaaggaaaacgtttgtggagctcatgagaagaggggatctacctgtctggctatcctacaaagttgcctcagaaggcttccagtactctgacagaagatggtgctttgatggggaaaggaacaatcaggtgttagaggagaacatggacgtggagatctggacaaaagaaggagaaagaaagaaactacgaccccgctggctggatgccagaacatactcagacccattggccctgcgcgagttcaaagagtttgcagcaggaagaagaagcgtctcaggtgatctaatattagaaatagggaaacttccacagcacttgacgcaaagggcccagaacgccttggacaacctggtcatgttgcacaactctgaacaaggaggaagagcctacagacatgcaatggaagaactcccagacaccatagaaacgttgatgctcctagctttgatagctgtgttaactggtggggtgacgttgttttttctatcaggaaggggcttagggaaaacatccatcggcctactctgcgtgatggcttcaagcgtgttgttatggatggccagtgtggagccccattggatagcggcctccatcatactagaattctttctgatggtgctgcttattccagagccagacagacaacgcactccacaggacaaccagttggcatatgtagtgataggtttgttattcatgatactgacagtagcagccaatgagatgggattactggaaaccacaaagaaagacttagggattggccatgtggctgctgaaaatcaccaccacgccacaatgttggacgtagacttacatccagcttcagcctggaccctctatgcagtggccacaacaattatcacacccatgatgaggcacacaatcgaaaacacaacggcaaatatttccctgacagctattgcaaaccaggcagccatattgatgggactcgacaaaggatggccaatatcgaagatggacataggagttccacttctcgccttggggtgctattcccaggtgaatccactgacgctgacagcggcagtattgatgctagtggctcattatgccataattggacctggactgcaagcaaaagctactagagaagcccaaaaaaggacagcggctggaataatgaagaatccaactgtcgatggaataattgcaatagatttggaccctgtggtttatgatgcaaaatttgagaaacaactaggccaaataatgttgttgatactatgcacatcacagatcctcttgatgcggactacgtgggccttgtgtgaatccatcacgctggctactggacctttgaccacgctttgggaaggatctccaggaaaattttggaacaccacgatagccgtgtccatggcaaacatattcaggggaagttatctagcaggagcaggcctggccttctcactaatgaaatctctaggaggaggtaggagaggcacgggagcccaaggggaaacactgggagaaaaatggaaaagacagctaaaccaactgagcaagtcagaatttaacacttacaaaaggagtgggattatagaagtggatagattcgaagccaaagagggactgaaaagaggagaaacaaccaaacatgcagtgtcgagaggaaccgccaaactgaggtggtttgtggagaggaaccttgtgaaaccagaagggaaagtcatagacctcggttgtggaagaggtggctggtcatattattgcgccgggctgaagaaagtcacagaagtgaagggatacacaaaaggaggacctggacatgaagaaccaatcccaatggcgacctatggatggaacctagtaaagctgtactctgggaaagacgtgttctttacaccacctgagaaatgtgacacccttttgtgtgatattggtgagtcctctccgaacccaaccatagaagaaggaagaacgttacgtgtcctaaagatggtggaaccatggctccgaggaaaccaattttgcataaaaattctaaatccctacatgccaagtgtggtggaaactctggagcagatgcaaagaaaacatggaggaatgctagtgcgaaatccactctcaagaaattccactcatgaaatgtattgggtttcatgtggaacaggaaacattgtgtcagcagtaaacatgacatctagaatgttgctaaatcgattcacaatggctcacaggaaaccaacatatgaaaaagacgtggacttaggcgctggaacaagacatgtggcagtggaaccagaggtagccaacctagatatcattggccagaggatagagaacataaaacatgaacataagtcaacatggcattatgatgaggacaatccatacaagacatgggcctatcatggatcatatgaggtcaagccatcaggatcagcctcatccatggtcaatggcgtggtgagactgctcaccaaaccatgggatgtcattcccatggtcacacaaatagccatgactgacaccacaccctttggacaacagagggtgtttaaagagaaagttgacacgcgcacaccaaaagcaaaacaaggcacagcacaaatcatggaagtgacagctagatggttatggggttttctttctagaaacaaaaaaccaagaatctgcacaagagaggagttcacaagaaaagttaggtcaaacgcagctattggagcagtgttcgttgatgaaaatcaatggaactctgcaaaagaagcagtggaagacgaacggttttgggaccttgtgcacagagagagggagcttcacaaacagggaaagtgtgccacgtgtgtttacaatatgatggggaagagagagaaaaaactaggagagttcggaaaggcaaaaggaagtcgcgcaatatggtacatgtggttgggagcacgctttctagagtttgaagcccttggcttcatgaacgaagatcactggttcagtagagagaattcactcagtggagtggaaggagaaggactccatagactcggatatatactcagagacatatcaaagattccagggggaaatatgtatgcagatgacacagccggatgggacacaaggataacagaggatgatcttcagaatgaggccaaaatcactgacatcatggagcccgaacatgccctactggctacgtcaatctttaagctgacctaccaaaataaggtggtgagggtgcagagaccagcaaaaaatggaaccgtgatggatgttatatccagacgtgatcagagaggaagtggccaggtcggaacttatggcttaaacactttcaccaatatgggggtccagctaataagacaaatggagtctgagggaatcttttcacccagcgaattagagaccccaaatttggccgagagagttctcgactggttggataagtatggcgtcgaaaggctgaaaagaatggcaatcagcggagatgactgcgtggtgaaaccaattgatgacaggttcgcgacagccctaacagctctgaacgacatgggaaaagtaagaaaagacataccacaatgggaaccttcaaaaggatggaatgactggcaacaagtgcctttttgttcacaccatttccaccagctgattatgaaggatgggagggaaatagtggtgccatgccgcaatcaagatgaactcgtgggtagggctagagtgtcacaaggtgccggatggagcctgagagaaactgcatgcctgggcaagtcatatgcacaaatgtggcagctgatgtacttccacaggagagacctgagactagctgctaatgccatctgctcggccgttccagttgattgggtcccaatcagccgcaccacttggtcgatccacgcccatcatcaatggatgacaacagaaaacatgctgtcagtgtggaatagggtttggatagaggaaaacccatggatggaggacaaaacccatgtatccagctgggaagatgttccatacttagggaaaagggaagatcagtggtgtggttccctgataggtttaacagcaagggccacctgggccaccaacatacaagtggccataaaccaagtgagaaggctaattgggaatgagaattatctagattacatgacatcaatgaagagattcaagaacgagagcgatcccgaaggggcactctggtga

SEQ ID NO: 63 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggccttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcagaaccagatgacgttgattgttggtgcaatgccacagactcatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaacggctgtgggctcttcggaaaaggaagcctaataacgtgtgctaagttcaagtgtgtgacaaaactggaaggaaagatagtccaatatgaaaacttgaaatattcagtaatagtcaccgtccacactggagaccagcaccaggtgggaaatgaaagcacagaacatgggacaactgcaactataacacctcaagctcctacaacggaaatacagctgaccgactacggagctcttacattggattgttcacctagaacaggactagattttaatgaaatggtgttgttgacaatgaaagaaaaatcatggctagtccacaaacaatggtttttagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgctggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattggtacaccagatttttggaactgcatatggagtattgttcagcggtgtttcctggaccatgaaaataggaataggggttctgctgacatggctaggattaaactcaaggagcacgtccctttcgatgacgtgtattgcagttggcctagtaacactatacttaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggattttggctcaagggaaaaagatgattaggccacaacccatggaatacaaatactcgtggaaaagctggggaaaggctaaaatcataggggcagatgtacagaacgccaccttcatcatcgacggcccaaacacccctgaatgtcctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggatactggatagaaagtgaaaagaacgagacctggaagctggcaagagcctctttcatagaagttaaaacatgtgtctggccaaaatcccacactctatggagcaatggagttctggaaagtgaaatgataattccaaagatctatggaggaccaatatcccagcacaaccacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaacctagtcaaatcaatggtctctgcagggtcaggggaagtggacagcttttcactagggctgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctattattccgcagactaacatccagagaagttcttcttctaacaattggactgagtctagtggcatctgtggagctaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtctctctcttccccttatgcctgtccacgacctcccaaaaaacaacatggcttccggtgctattgggatctcttggatgcaaaccactaaccatgtttcttatagcagaaaacaaaatctggggaaggaaaagttggcctctcaatgaaggaatcatggctgttggaatagtcagcatcctactaagttcactcctaaaaaatgatgtgccgctagctgggccactaatagctggaggcatgctaatagcatgttatgttatatctggaagctcagccgatctatcactagagaaagcggccgaggtctcttgggaagaagaagcagaacactctggtgcctcacacaacatattagtggaggtccaagatgatggaaccatgaagataaaggatgaagagagagatgacacgctaaccattctcctcaaagcaactctgctagcagtttcaggggtgtacccattatcaataccagcgaccctttttgtgtggtacttttggcagaaaaagaagcagagatctggggtgttatgggacacacctagccctccagaagtggaaagagcagttcttgatgatggtatttatagaattatgcagagaggactgttgggcaggtcccaagtaggggtaggagtttttcaagaaaacgtgttccacacaatgtggcatgtcaccaggggagctgtactcatgtatcaagggaagagactggagccgagctgggccagtgtcaaaaaagacctgatctcatatggaggaggctggaggcttcaaggatcctggaacacaggagaagaagtgcaggtgattgctgttgaaccagggaaaaaccccaaaaatgtacaaacagcgccaggcacctttaagacccctgaaggcgaagttggagctattgccctagattttaaacccggcacatctggatctcccatcgtgaacagagaaggaaaaatagtaggtctttatggaaatggagtagtgacaacaagtggaacctacgtcagcgccatagctcaagctaaagcatcacaagaagggcccctaccagagattgaagacgaggtgtttaggaagagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatggaaaacgggtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgttattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacttttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctgatattagaaatagggaaacttccacaacatttgacgcaaagggcccagaatgccttggacaacctggttatgttgcacaactccgaacaaggaggaagagcctatagacatgcactggaagaactgccagacaccatagaaacgttgatgctcctagctttgatagctgtgttaactggtggagtgacgctgttcttcctatcaggaaggggcctagggaaaacatctattggcctactctgcgtgatggcttcaagcgcactgctatggatggccagtgtggagccccattggatagcggcctccatcatactggagttcttcctgatggtgctgctcattccagagccagacagacaacgcactccgcaggacaaccagctggcatatgtggtgataggtctgttattcatgatactgacagtagcagccaatgagatgggactgctggaaaccacaaagaaagacttagggattggccatgtggctgttgaaaatcaccaccatgcctcaatgctggacgtagacttacacccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccattgacgctgacagcggcggtattgatgctagtggctcattacgccataattggacctggactgcaagcgaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactaaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacacccttttatgtgatattggtgagtcctctccaaacccaactatagaggaaggaagaacgctacgcgtcctaaagatggtggaaccatggcttagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatccagaatgttgttaaatcgattcacaatggctcacaggaaaccaacatatgaaagagatgtggacctaggcgccggaacaagacatgtggcagtggaaccagaggtagccaacctagatatcattggtcagaggatagagaacataaaacatgaacataagtcaacatggcattatgatgaggacaatccatataaaacatgggcctatcatggatcatatgaggtcaagccatcaggatcagcttcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaaccaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaagtcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgaggaaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgctcacaccacttccaccagctgattatgaaggatgggagggaagtagtggtgccatgccgcaaccaagatgaacttgtgggtagggctagagtatcacaaggcgctggatggagcctgagagaaactgcatgcctaggcaagtcatatgcacaaatgtggcagctgatgtacttccacaggagagacttgagactagccgctaatgctatctgttcagccgttccagttgattgggtcccaaccagccgcaccacctggtcgatccatgcccaccaccagtggatgacaacagaagacatgctgtcagtgtggaatagggtttggatagaggaaaacccatggatggaggacaaaacccatgtatccagttgggaagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaaaaacgagagtgatcccgaaggggcactctggtga

SEQ ID NO: 64 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgattaaagtgttacggggtttcaagaaagaaatctcaaacatgttgaatataatgaatagaaggaagagatcagtgaccatgctccttatgctgctgcccacaaccttggcgtttcatctgaccacacgagggggagagccgcatatgatagttaccaagcaggaaagaggaaagtcacttttgtttaagacctcagctggtgtcaacatgtgcaccctcattgcaatggacttgggagagttatgtgaggacacaatgacttacaaatgtcctcgaatcactgaggcggaaccagatgacgttgattgttggtgcaatgccactgacacatgggtgacctatggaacatgttctcaaactggcgaacaccgacgagacaaacgttccgtcgcactggctccacacgtgggacttggtctagaaacaagaaccgaaacgtggatgtcctctgaaggcgcctggaaacaaatacaaagagtggagacttgggccctgagacacccaggattcacagtgatagccctttttctagcacatgccataggaacatccatcacccagaaagggattatcttcattttgttgatgctggtaacaccatccatggccatgcgatgtgtgggaataggcaacagggacttcgtggaaggactgtcaggagcaacgtgggtggatgtggtactggaacatggaagttgtgtcaccaccatggcaaaagataaaccaacattggacattgaactcttgaagacggaagtcacaaaccctgccgtcctgcgcaaactgtgcattgaagctaaaatatcaaacaccaccaccgactcaagatgtccaacacaaggagaggccacactggtggaagaacaagacgcgaattttgtgtgccgacgaacgtttgtggacagaggctggggcaatggctgtggactttttggaaaaggtagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatggaacaacagcaactataacgcctcaagctcccacgtcggaaatacagctgaccgactacggagctcttacattggattgctcacctagaacaggactagacttcaatgaaatggtgttgttgacaatgaaagaaaaatcatggctagtccacaaacaatggtttctagacctaccactgccttggacctcgggagctacaacgtcacaagagacttggaacagacaagatttgctggtaacattcaagacagctcatgcaaagaagcaggaagtggtcgtactaggatcacaagaaggagcaatgcacactgcgttgaccggagcgacagaaatccaaacgtctggaacgacaacaatttttgcaggacacttgaaatgtagactaaaaatggacaaactgactctaaaagggatgtcatatgtgatgtgcacaggctcattcaagctagagaaagaggtggctgagacccagcatggaaccgttctagtgcaggttaaatacgaaggaacagatgcaccatgcaagatccctttttcgacccaagatgaaaaaggagtaacccagaatgggagagtgataacagccaaccctatagtcactgacaaggaaaaaccagtcaacattgaggcagaaccaccttttggtgagagttacatcgtggtaggagctggtgagaaagctttgaaactaagctggttcaagaaaggaagtaccatagggaaaatgtttgaggcaaccgcccgaggagcacgaaggatggccatactgggagacaccgcatgggactttggttccataggaggagtgttcacatctgttggaaaactagtacaccagatttttggaactgcatatggagttttgttcagcggtgtttcctggaccatgaaaataggaataggggttctgctgacatggctaggattaaactcaaggagcacgtctctttcgatgacgtgcattgcagttggcctggtaacactgtacctaggagtcatggttcaggcggattcaggatgtgtaattaactggaaaggcagagaactcaaatgtggaagtggcatttttgtcaccaatgaagttcacacttggacagagcaatacaaatttcaggctgactccccaaagagactatcagcagccatcgggaaggcatgggaggagggtgtgtgtggaattcgatcagccactcgtctcgagaatatcatgtggaagcaaatatcaaatgaactgaaccacattttacttgaaaatgacatgaaattcacagtggttgttggagatgttggtgggatcttggcccaaggaaaaaaaatgattaggccacaacccatggaatacaaatactcgtggaaaagctggggaaaagctaaaatcataggggcagatgtacagaactccaccttcatcattgacggcccaaacaccccagaatgccccgatgatcaaagagcatggaacatttgggaagttgaggactatggatttggaattttcacgacaaacatatggttgaaattgcgtgactcctacacccaagtgtgtgaccaccggctaatgtcagctgccatcaaggacagcaaggcagttcatgctgacatggggtactggatagaaagtgaaaagaacgagacttggaagctggcaagagcctcctttatagaagttaaaacatgcgtttggccaaaatcccacactctatggagcaatggagttctggaaagtgaaatgataattccaaagatatatggaggaccaatatctcagcacaactacagaccaggatatttcacacaaacagcagggccgtggcacctaggcaagttggaactagattttaatttgtgtgagggtaccacagttgttgtggatgaacattgtggaaatcgaggaccatctcttagaaccacaacagtcacaggaaaaataatccatgaatggtgctgcagatcctgtacgctaccacccttacgtttcaaaggagaagatgggtgttggtatggtatggaaattagaccagtcaaggaaaaggaagagaatctagtcaaatcaatggtctctgcagggtccggagaagtggacagcttttcactaggactgctatgcatatcaataatgaccgaagaggtgatgagatctagatggagtagaaaaatgctgatgactggaacgctggctgtgttcctccttctcataatgggacaattgacatggaatgatctgatcaggttatgcatcatggttggagccaatgcttcagacaggatggggatgggaacaacgtacctagctctgatggccacttttaaaatgagaccaatgtttgctgtcgggctgttattccgcagactaacatctagagaagttcttcttcttacaattggattgagtctagtggcatccgtggagctaccaaattccttggaggagctgggggatggacttgcaatgggcattatgatcttaaaattactgactgactttcaatcacatcagctgtgggctgccttgctgtccctgacatttattaaaacaactttttctttgcattatgcatggaagacaatggctatggtactgtcaattgtgtctctcttccccttatgcctgtccacgacctctcaaaaaacaacatggcttccggtgctattgggatctcttggatgcaagccactaaccatgtttctcatagtagaaaacaaaatttggggaaggaaaagttggcctctcaatgaaggaatcatggctgttggaatagtcagcatcttactaagctcactcctcaagaatgacgtgccgctagctgggccactaatagctggaggcatgctaatagcatgttatgttatatctggaagctcagccgatttatcattagagaaagcggctgaggtctcctgggaagaagaagcagaacactctggtgcctcacacaatatattagtggaggtccaagatgatggaaccatgaagataaaagatgaagagagagatgacacactaaccattctccttaaagcaactttgctggcagtttcagggatgtacccattatcaataccagcgaccctttttgtgtggtatttttggcagaagaagaaacagagatcaggagtgttatgggacacacctagccctccagaagtggaaagagcagttcttgatgatggtatctatagaattatgcagagaggactgttgggcagatcccaagtaggggtaggagttttccaagaaaacgtgttccacacaatgtggcatgtcaccaggggagctgtactcatgtatcaagggaagagactggaaccaagttgggctagtgtcaaaaaagacctgatctcatatggaggaggttggaggcttcaaggatcctggaacacgggagaagaagtgcaggtgattgctgttgaaccaggaaaaaaccccaaaaatgtacagacagcgccgggcaccttcaagacccctgaaggtgaagttggagccatagccctagattttaaacccggcacatctggatcccccatcgtgaacagagaggggaaaatagtaggtctttatggaaatggagtagtgacaacaagcggaacctacgtcagtgccatagctcaagctaaagcatcacaagaagggcccctaccagagattgaggacgaggtgtttaggaaaagaaacttaacaataatggacctacatccaggatcgggaaaaacaagaagatatcttccagccatagtccgtgaggccataaaaaggaagctgcgcacactaattttggctcccacaagagttgtcgcttccgaaatggcagaggcgctcaaaggaatgccgataaggtatcagacaacagcagtgaagagtgaacacacaggaaaagagatagttgacctcatgtgccacgccactttcactatgcgtctcctgtctcccgtgagagttcccaattacaacatgattatcatggatgaagcacatttcaccgatccatccagcatagcggccagagggtacatctcaacccgagtgggtatgggtgaagcagctgcgatcttcatgacagccactcccccaggatcggtggaggcctttccacagagtaatgcagttatccaagatgaggaaagagacattcctgagagatcgtggaactcaggctatgactggatcactgacttcccaggtaaaacggtctggtttgttccaagcatcaaatcaggaaatgacattgccaactgcttaagaaagaatgggaaacgggtgattcaattgagcaggaaaacctttgacacagagtaccaaaagacaaaaaacaacgactgggactatgtcgtcacaacagacatctccgaaatgggagctaacttccgagccgacagggtaatagacccaagacggtgtctgaaaccggtaatactgaaagatggtccagagcgtgtcattctagcaggaccgatgccagtgactgtggccagtgccgcccagaggagaggaagaatcggaaggaaccaaaacaaggaaggtgatcagtacatctacatgggacagcctttaaataacgatgaagaccacgctcattggacagaagcaaaaatgctccttgacaatataaacacaccagaagggattatcccagccctctttgaaccggagagagaaaagagtgcggcaatagacggggaatatagactgcggggtgaagcaaggaaaacgtttgtggagctcatgagaagaggggatctacctgtctggctatcctacaaagttgcctcagaaggcttccagtactctgacagaagatggtgctttgatggggaaaggaacaatcaggtgttggaggagaacatggacgtggagatctggacaaaagaaggagaaagaaagaaactacgaccccgctggctggatgccagaacatactcagacccattggccctgcgcgagttcaaagagtttgcagcaggaagaagaagcgtctcaggtgatctaatattagaaatagggaaacttccacagcacttgacgcaaagggcccagaacgccttggacaacctggtcatgttgcacaactctgaacaaggaggaagagcctacagacatgcaatggaagaactcccagacaccatagaaacgttgatgctcctagctttgatagctgtgttaactggtggggtaacgttgttttttctatcaggaaggggcttagggaaaacatctatcggcctactctgcgtgatggcttcaagcgtgttgttatggatggccagtgtggagccccattggatagcggcctccatcatactaaaattctttctgatggtgctgcttattccagagccagacagacaacgcactccacaggacaaccagttggcatatgtagtgataggtttgttattcatgatactgacagtagcagccaatgagatgggattactggaaaccacaaagaaagacttagggattggccatgtggctgctgaaaatcaccaccacgccacaatgttggacgtagacttacatccagcttcagcctggaccctctatgcagtggccacaacaattatcacacccatgatgaggcacacaatcgaaaacacaacggcaaatatttccctgacagctattgcaaaccaggcagccatattgatgggactcgacaaaggatggccaatatcgaagatggacataggagttccacttctcgccttggggtgctattcccaggtgaatccactgacgctgacagcggcagtattgatgctagtggctcattatgccataattggacctggactgcaagcaaaagctactagagaagcccaaaaaaggacagcggctggaataatgaagaatccaactgtcgatggaataattgcaatagatttggaccctgtggtttatgatgcaaaatttgagaaacaactaggccaaataatgttgttgatactatgcacatcacagatcctcttgatgcggactacgtgggccttgtgtgaatccatcacgctggctactggacctctgaccacgctttgggaaggatctccaggaaaattttggaacaccacgatagccgtgtccatggcaaacatattcaggggaagttatctagcaggagcaggcctggccttctcactaatgaaatctctaggaggaggtaggagaggcacgggagcccaaggggaaacactgggagaaaaatggaaaagacagctaaaccaactgagcaagtcagaatttaacacttacaaaaggagtgggattatagaagtggatagattcgaagccaaagagggactgaaaagaggagaaacaaccaaacatgcagtgtcgagaggaaccgccaaactgaggtggtttgtggagaggaaccttgtgaaaccagaagggaaagtcatagacctcggttgtggaagaggtggctggtcatattattgcgccgggctgaagaaagtcacagaagtgaagggatacacaaaaggaggacctggacatgaagaaccaatcccaatggcgacctatggatggaacctagtaaagctgtactctgggaaagacgtgttctttacaccacctgagaaatgtgacacccttttgtgtgatattggtgagtcctctccgaacccaaccatagaagaaggaagaacgttacgtgtcctaaagatggtggaaccatggctccgaggaaaccaattttgcataaaaattctaaatccctacatgccaagtgtggtggaaactctggagcagatgcaaagaaaacatggaggaatgctagtgcgaaatccactctcaagaaattccactcatgaaatgtattgggtttcatgtggaacaggaaacattgtgtcagcagtaaacatgacatctagaatgttgctaaatcgattcacaatggctcacaggaaaccaacatatgaaaaagacgtggacttaggcgctggaacaagacatgtggcagtggaaccagaggtagccaacctagatatcattggccagaggatagagaacataaaacatgaacataagtcaacatggcattatgatgaggacaatccatacaagacatgggcctatcatggatcatatgaggtcaagccatcaggatcagcctcatccatggtcaatggcgtggtgagactgctcaccaaaccatgggatgtcattcccatggtcacacaaatagccatgactgacaccacaccctttggacaacagagggtgtttaaagagaaagttgacacgcgcacaccaaaagcaaaacaaggcacagcacaaatcatggaagtgacagctagatggttatggggttttctttctagaaacaaaaaaccaagaatctgcacaagagaggagttcacaagaaaagttaggtcaaacgcagctattggagcagtgttcgttgatgaaaatcaatggaactctgcaaaagaagcagtggaagacgaacggttttgggaccttgtgcacagagagagggagcttcacaaacagggaaagtgtgccacgtgtgtttacaatatgatggggaagagagagaaaaaactaggagagttcggaaaggcaaaaggaagtcgtgcaatatggtacatgtggttgggagcacgctttctagagtttgaagcccttggcttcatgaacgaagatcactggttcagtagagagaattcactcagtggagtggaaggagaaggactccatagactcggatatatactcagagacatatcaaagattccagggggaaatatgtatgcagatgacacagccggatgggacacaaggataacagaggatgatcttcagaatgaggccaaaatcactgacatcatggagcccgaacatgccctactggctacgtcaatctttaagctgacctaccaaaataaggtggtgagggtgcagagaccagcaaaaaatggaaccgtgatggatgttatatccagacgtgatcagagaggaagtggccaggtcggaacttatggcttaaacactttcaccaatatgggggtccagctaataagacaaatggagtctgagggaatcttttcacccagcgaattagagaccccaaatttggccgagagagttctcgactggttggaaaagtatggcgtcgaaaggctgaaaagaatggcaatcagcggagatgactgcgtggtgaaaccaattgatgacaggttcgcgacagccctaacagctctgaacgacatgggaaaagtaagaaaagacataccacaatgggaaccttcaaaaggatggaatgactggcaacaagtgcctttttgttcacaccatttccaccagctgattatgaaggatgggagggaaatagtggtgccatgccgcaatcaagatgaactcgtgggtagggctagagtgtcacaaggtgccggatggagcctgagagaaactgcatgcctgggcaagtcatatgcacaaatgtggcagctgatgtacttccacaggagagacctgagactagctgctaatgccatctgctcggccgttccagttgattgggtcccaaccagccgcaccacttggtcgatccacgcccatcatcaatggatgacaacagaaaacatgctgtcagtgtggaatagggtttggatagaggaaaacccatggatggaggacaaaacccatgtatccagctgggaagatgttccatacttagggaaaagggaagatcagtggtgtggttccctgataggtttaacagcaagggccacctgggccacccacatacaagtggccataaaccaagtgagaagactaattgggaatgagaattatctagattacatgacatcaatgaagagattcaagaacgagagtgatcccgaaggggcactctggtga

SEQ ID NO: 65 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgattaaagtgttacggggtttcaagaaagaaatctcaaacatgttgaatataatgaatagaaggaagagatcagtgaccatgctccttatgctgctgcccacaaccttggcgtttcatctgaccacacgagggggagagccgcatatgatagttaccaagcaggaaagaggaaagtcacttttgtttaagacctcagctggtgtcaacatgtgcacccttattgcaatggatttgggagagttatgtgaggacacaatgacttacaaatgtcctcgaatcactgaggcggaaccagatgacgttgattgttggtgcaatgccactgacacatgggtgacctatggaacatgttctcaaactggcgaacaccgacgagacaaacgttccgtcgcactggctccacacgtgggacttggtctagaaacaagaaccgaaacgtggatgtcctctgaaggcgcctggaaacaaatacaaagagtggagacttgggccctgagacacccaggattcacagtgatagccctttttctagcacatgccataggaacatccatcacccagaaagggattatcttcattttgttgatgctggtaacaccatccatggccatgcgatgtgtgggaataggcaacagggacttcgtggaaggactgtcaggagcaacgtgggtggatgtggtactggaacatggaagttgtgtcaccaccatggcaaaagataaaccaacattggacattgaactcctgaagacggaagtcacaaaccctgccgtcctgcgcaaactgtgcattgaagctaaaatatcaaacaccaccaccgactcaagatgtccaacacaaggagaggccacactggtggaagaacaagacgcgaattttgtgtgccgacgaacgtttgtggacagaggctggggcaatggctgtggactttttggaaaaggtagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatggaacaacagcaactataacgcctcaagctcccacgtcggaaatacagctgaccgactacggagctcttacattggattgctcacctagaacaggactagacttcaatgaaatggtgttgttgacaatgaaagaaaaatcatggctagtccacaaacaatggtttctagacctaccactgccttggacctcgggagctacaacgtcacaagagacttggaacagacaagatttgctggtaacattcaagacagctcatgcaaagaagcaggaagtggtcgtactaggatcacaagaaggagcaatgcacactgcgttgaccggagcgacagaaatccaaacgtctggaacgacaacaatttttgcaggacacttgaaatgtagactaaaaatggacaaactgactctaaaagggatgtcatatgtgatgtgcacaggctcattcaagctagagaaagaggtggctgagacccagcatggaaccgttctagtgcaggttaaatacgaaggaacagatgcaccatgcaagatccctttttcgacccaagatgaaaaaggtgtaacccagaatgggagagtgataacagccaaccctatagtcactgacaaggaaaaaccagtcaacattgaggcagaaccaccttttggtgagagttacatcgtggtaggagctggtgagaaagctttgaaactaagctggttcaagaaaggaagcaccatagggaaaatgtttgaggcaaccgcccgaggagcacgaaggatggccatactgggagacaccgcatgggactttggttccataggaggagtgttcacatctgttggaaaattagtacaccagatttttggaactgcatatggagttttgttcagcggtgtttcctggaccatgaaaataggaataggggttctgctgacatggctaggattaaactcaaggagcacgtctctttcgatgacgtgcattgcagttggcctgataacactgtacctaggagtcatggttcaggcggattcaggatgtgtaattaactggaaaggcagagaactcaaatgtggaagtggcatttttgtcactaatgaagttcacacttggacagagcaatacaaatttcaggctgactccccaaagagactatcagcagccatcgggaaggcatgggaggagggtgtgtgtggaattcgatcagccactcgtctcgagaatatcatgtggaagcaaatatcaaatgaactgaaccacattttacttgaaaatgacatgaaattcacagtggttgtaggagatgttagtgggatcttggcccaagggaaaaaaatgattaggccacaacccatggaatacaaatactcgtggaaaagctggggaaaagctaaaatcataggggcagatgtacagaactccaccttcatcattgacggcccaaacaccccagaatgccccgatgatcaaagagcatggaacatttgggaagttgaggactatggatttggaattttcacgacaaacatatggttgaaattgcgtgactcctacacccaagtgtgtgaccaccggctaatgtcagctgccatcaaggacagcaaggcagttcatgctgacatggggtactggatagaaagtgaaaagaacgagacttggaagctggcaagagcctccttcatagaagttaaaacatgcgtttggccaaaatcccacactctatggagcaatggagttctggaaagtgaaatgataattccaaagatatatggaggaccaatatctcagcataactacagaccaggatatttcacacaaacagcagggccgtggcacctaggcaagttggaactagattttaatttgtgtgagggtaccacagttgttgtggatgaacattgtggaaatcgaggaccatctcttagaaccacaacagtcacaggaaaaataattcatgaatggtgctgcagatcttgtacgctaccacccttacgtttcaaaggagaagatgggtgttggtatggtatggaaattagaccagtcaaggaaaaggaagagaatctagtcaaatcaatggtctctgcagggtccggagaagtggacagcttttcactaggactgctatgcatatcaataatgaccgaagaggtgatgagatctagatggagtagaaaaatgctgatgactggaacgctggctgtgttcctccttctcataatgggacaattgacatggaatgatctgatcaggttatgcattatggttggagccaatgcttcagacaggatggggatgggaacaacgtacctagctctgatggccacttttaaaatgagaccaatgtttgctgtcgggctgttattccgcagactaacatctagagaagttcttcttcttacaattggattgagtctagtggcatccgtggagctaccaaattccttggaggagctgggggatggacttgcaatgggcattatgatcttaaaattactgactgactttcaatcacatcagctgtgggctgccttgctgtccctgacatttatcaaaacaactttttctttgcattatgcatggaagacaatggctatggtactgtcaattgtgtctctcttccccttatgcctgtccacgacctctcaaaaaacaacatggcttccggtgctattgggatctcttggatgcaaaccactaaccatgtttctcatagtagaaaacaaaatttggggaaggaaaagttggcctctcaatgaaggaatcatggctgttggaatagtcagcatcttactaagctcactcctcaagaatgacgtgccgctagctgggccattaataactggaggcatgctaatagcgtgttatgttatatctggaagctcagccgatttatcattagagaaagcggctgaggtctcctgggaagaagaagcagaacactctggtgcctcacacaatatattagtggaggtccaagatgatggaaccatgaagataaaagatgaagagagagatgacacactaaccattctccttaaagcaactttgctggcagtttcagggatgtacccattatcaataccagcgaccctttttgtgtggtatttttggcagaagaagaaacagagatcaggagtgttatgggacacacctagccctccagaagtggaaagagcagttcttgatgatggtatctatagaattatgcagagaggactgttgggcagatcccaagtaggggtaggagttttccaagaaaacgtgttccacacaatgtggcatgtcaccaggggagctgtactcatgtatcaagggaagagactggaaccaagttgggctagtgtcaaaaaagacctgatctcatatggaggaggttggaggcttcaaggatcctggaacacgggagaagaagtgcaggtgatcgctgttgaaccaggaaaaaaccccaaaaatgtacagacagcgccgggcaccttcaagacccctgaaggtgaagttggagccatagccctagattttaaacccggcacatctggatcccccatcgtgaacagagaggggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagagttgtcgcttccgaaatggcagaggcgctcaaaggaatgccaataaggtatcagacaacagcagtgaagagtgaacacacaggaaaagagatagttgacctcatgtgccacgccactttcactatgcgtcttctgtctcccgtgagagttcccaattacaacatgattatcatggatgaagcacatttcaccgatccatccagcatagcggccagagggtacatctcaacccgagtgggtatgggtgaagcagctgcgatcttcatgacagccactcccccaggatcggtggaggcctttccacagagtaatgcagttatccaagatgaggaaagagacattcctgagagatcgtggaactcaggctatgactggatcactgacttcccaggtaaaacggtctggtttgttccaagcatcaaatcaggaaatgacattgccaactgcttaagaaagaatgggaaacgggtgattcaattgagcaggaaaacctttgacacagagtaccaaaagacaaaaaacaacgactgggactatgtcgtcacaacagacatctccgaaatgggagctaacttccgagccgacagggtaatagacccaagacggtgtctgaaaccggtaatactgaaagatggtccagagcgtgtcattctagcaggaccgatgccagtgactgtggccagtgccgcccagaggagaggaagaatcggaaggaaccaaaacaaggaaggtgatcagtacatctacatgggacagcctttaaataacgatgaagaccacgctcattggacagaagcaaaaatgctccttgataatataaacacaccagaagggattatcccagccctctttgaaccggagagagaaaagagtgcggcaatagacggggaatatagactgcggggtgaagcaaggaaaacgtttgtggagctcatgagaagaggggatctacctgtctggctatcctacaaagttgcctcagaaggcttccagtactctgacagaagatggtgctttgatggggaaaggaacaatcaggtgttggaggagaacatggacgtggagatctggacaaaagaaggagaaagaaagaaactacgaccccgctggctggatgccagaacatactcagacccattggccctgcgcgagttcaaagagtttgcagcaggaagaagaagcgtctcaggtgatctaatattagaaatagggaaacttccacagcacttgacgcaaagggcccagaacgccttggacaacctggtcatgttgcacaactctgaacaaggaggaagagcctacagacatgcaatggaagaactcccagacaccatagaaacgttgatgctcctagctttgatagctgtgttaactggtggggtgacgttgttttttctatcaggaaggggcttagggaaaacatctatcggcctactctgcgtgatggcttcaagcgtgttgttatggatggccagtgtggagccccattggatagcggcctccatcatactagaattctttctgatggtgctgcttattccagagccagacagacaacgcactccacaggacaaccagttggcatatgtagtgataggtttgttattcatgatactgacagtagcagccaatgagatgggattactggaaaccacaaagaaagacttagggattggccatgtggctgctgaaaatcaccatcacgccacaatgttggacgtagacttacatccagcttcagcctggaccctctatgcagtggccacaacaattatcacacccatgatgaggcacacaatcgaaaatacaacggcaaatatttccctgacagctattgcaaaccaggcagccatattgatgggactcgacaaaggatggccaatatcgaagatggacataggagttccacttctcgccttggggtgctattcccaggtgaatccactgacgctgacagcggcagtattgatgctagtggctcattatgccataattggacctggactgcaagcaaaagctactagagaagcccaaaaaaggacagcggctggaataatgaagaatccaactgtcgatggaataattgcaatagatttggaccctgtggtttatgatgcaaaatttgagaaacaactaggccaaataatgttgttgatactatgcacatcacagatcctcttgatgcggactacgtgggccttgtgtgaatccatcacgctggctactggacctctgaccacgctttgggaaggatctccaggaaaattttggaacaccacgatagccgtgtccatggcaaacatattcaggggaagttatctagcaggagcaggcctggccttctcactaatgaaatctctaggaggaggtaggagaggcacgggagcccaaggggaaacactgggagaaaaatggaaaagacagctaaaccaactgagcaagtcagaatttaacacttacaaaaggagtgggattatagaagtggatagatccgaagccaaagagggactgaaaagaggagaaacaaccaaacatgcagtgtcgagaggaaccgccaaactgaggtggtttgtggagagaaatcttgtgaaaccagaagggaaagtcatagacctcggttgtggaagaggtggctggtcatattattgcgccgggctgaagaaagtcacagaagtgaagggatacacaaaaggaggacctggacatgaagaaccaatcccaatggcgacctatggatggaacctagtaaagctgtactctgggaaagacgtattctttacaccacctgagaaatgtgacacccttttgtgtgatattggtgagtcctctccaaacccaactatagaggaaggaagaacgttacgtgtcctaaagatggtggaaccatggctccgaggaaaccaattttgcataaaaattctaaatccctacatgccaagtgtggtggaaactctggagcaaatgcaaagaaaacatggaggaatgctagtgcgaaatccactctcaagaaattccactcatgaaatgtattgggtttcatgtggaacaggaaacattgtgtcagcagtaaacatgacatctagaatgttgctaaatcgattcacaatggctcacaggaaaccaacatatgaaaaagacgtggacttaggcgctggaacaagacatgtggcagtggaaccagaggtagccaacctagatatcattggccagaggatagagaacataaaacatgaacataagtcaacatggcattatgatgaggacaatccatacaagacatgggcctatcatggatcatatgaggtcaagccatcaggatcagcctcatccatggtcaatggcgtggtgagactgctcaccaaaccatgggatgtcattcccatggtcacacaaatagccatgactgacaccacaccctttggacaacagagggtgtttaaagagaaagttgacacgcgcacaccaaaagcaaaacaaggcacagcacaaatcatggaagtgacagctagatggttatggggttttctttctagaaacaaaaaaccaagaatctgcacaagagaggagttcacaagaaaagttaggtcaaacgcagctattggagcagtgttcgttgatgaaaaccaatggaactctgcaaaagaagcagtggaagacgaacggttctgggaccttgtgcacagagagagggagcttcacaaacagggaaagtgtgccacgtgtgtttacaacatgatggggaagagagagaaaaaactaggagagttcggaaaggcaaaaggaagtcgtgcaatatggtacatgtggttgggagcacgctttctagagtttgaagcccttggcttcatgaacgaagatcactggttcagtagagagaattcactcagtggagtggaaggagaaggactccatagactcggatatatactcagagacatatcaaagattccagggggaaatatgtatgcagatgacacagccggatgggacacaaggataacagaggatgatcttcagaatgaggccaaaatcactgacatcatggagcccgaacatgccctactggccacgtcagtctttaagctgacctaccaaaataaggtggtgagggtgcagagaccagcaaaaaatggaaccgtgatggatgttatatccagacgtgaccagagaggaagtggccaggtcggaacttatggcttaaacactttcaccaacatggaagcccagctaataagacaaatggagtctgagggaatcttttcacccagcgaattagagaccccaaatttggccgagagagttctcgactggttggaaaagtatggcgtcgaaaggctgaaaagaatggcaatcagcggagatgactgcgtggtgaaaccaattgatgacaggttcgcgacagccctaacagctctgaacgacatgggaaaagtaagaaaagacataccacaatgggaaccttcaaaaggatggaatgactggcaacaagtgcctttttgttcacaccatttccaccagctgattatgaaggatgggagggaaatagtggtgccatgccgcaatcaagatgaactcgtgggtagggctagagtgtcacaaggtgccggatggagcctgagagaaactgcatgcctgggcaagtcatatgcacaaatgtggcagctgatgtacttccacaggagagacctgagactagctgctaatgccatctgctcggccgttccagttgattgggtcccaaccagccgcaccacttggtcgatccacgcccatcatcaatggatgacaacagaaaacatgctgtcagtgtggaatagggtttggatagaggaaaacccatggatggaggacaaaacccatgtatccagctgggaagatgttccatatttaggaaaaagggaagatcagtggtgtggttccctgataggtttaacagcaagggccacctgggccaccaacatacaagtggccataaaccaagtgagaaggctaattgggaatgagaattatctagattacatgacatcaatgaagagattcaagaacgagagcgatcccgaaggggcactctggtga

SEQ ID NO: 66 - DNA, 10179 bp, Dengue virus
atgaacaaccaacggaagaagacgggtcgaccgtctttcaatatgctgaaacgcgcgagaaaccgcgtgtcaactggttcacagttggcgaagagattctcaaaaggattgctctcaggccaaggacccatgaaattggtgatggctttcatagcattcctaagatttctagccatacccccaacagcaggaattttggctagatggagctcattcaagaagaacggagcgatcaaagtgttacggggtttcaaaaaagagatctcaagcatgctgaacataatgaacaggaggaaaagatcagtgaccatgcttcttatgctgttgcccacagccctggcattccatttgaccacacgagggggagagccacatatggtagttagcaagcaggaaagaggaaagtcactcttgtttaagacctctgcaggtgtcaacatgtgcaccctcattgcgatggatttgggagagctatgtgaggatacaatgacctacaaatgcccccggatcactgaggcggaaccagatgacgttgactgctggtgcaatgccacagacacatgggtgacctacggaacgtgttctcaaactggcggacaccgacgagataaacgttctgtcgcactggccccacacgtgggactgggtctagaaacaagaactgaaacatggatgtcttctgaaggcgcctggaaacaaatacaaaaagtggagacttgggccctgagacacccaggatttacggtgatagccctttttctagcacatgccataggaacatccatcacccagaaagggattattttcattctgctgatgctggtgacaccatcaatggccatgcgatgcgtgggaataggcaacagagactttgttgaaggactgtcaggagcaacatgggtggatgtggtactggagcatggaagctgcgtcaccaccatggcaaaaaataaaccaacattggacattgaactcttgaagacggaagtcacgaaccctgctgtcttgcgcaaactgtgcattgaagctaaaatatcaaataccaccaccgattcaagatgtccaacacaaggagaagctacactggtggaagaacaagacgcgaactttgtgtgtcgacgaacgttcgtggacagaggctggggtaatggctgtggactattcggaaaaggaagcctactaacgtgtgccaagttcaagtgtgtgacaaaactgaaaggaaagatagttcaatacgaaaacttgaaatattcagtgatagtcactgtccacactggggaccagcaccaagtgggaaatgagaccacagaacatggaacaattgcaaccataacacctcaagctcccacgtcggaaatacagctgaccgactacggagccctcacattggactgctcacctagaacagggctggactttaatgagatggtgctgctgacaatgaaagaaaaatcgtggcttgtccacaaacaatggtttctagacttaccattgccttggacctcgggggcttcgacatctcaagagacttggaacagacaagatttactggtcacatttaagacagctcatgcaaagaagcaggaagtggtcgtgctgggatcacaagaaggagcaatgcacactgcgctgactggggcgacggaaatccagacgtcaggaacgacaacaatttttgcagggcacctgaaatgcagactaaaaatggataaactcactctaaaagggatgtcatatgtgatgtgcacaggctcatttaagttagagaaggaagtggctgagacccagcatggaaccgtcttagtgcaggttaaatacgaaggagcagacgcaccatgcaagatacccttttcgacccaagatgagaaaggagtgacccagaatgggagattgataacagccaatcccatagttactgacaaagaaaaaccagtcaacattgagacagaaccaccttttggtgagagctacatcgtgataggggcaggtgaaaaagctttgaaactaagctggttcaagaaaggaagcagcatagggaaaatgttcgaagctaccgcccgaggagcacgaaggatggccatcctgggagacaccgcatgggacttcggttctataggaggagtgttcacatctgtgggaaaattggtacaccaggtctttggagccgcatatggggttttgttcagcggtgtttcttggaccatgaaaataggaatagggattctgctgacatggctgggaataaattcaaggagcacgtcactttcgatgacgtgcattgcagttggcatggtcacactgtacctaggagtcacggtccaagcggactcggggtgtgtaatcaattggaagggcagagaactcaaatgtggaagtggcatttttgtcactaatgaagtccacacttggacagagcaatataaattccaggctgactccccaaaaagactgtcagcagccattgggaaggcatgggaggagggcgtgtgtggaattcgatcagccacacgtcttgagaacattatgtggaagcaaatatcaaatgaattgaaccacattctacttgaaaatgacatgaagttcacagtggttgtaggagatgccaatggaattttgacccaagggaaaaaaatgattaggccgcagcccatggaacacaaatactcatggaaaagctggggaaaagccaaaattataggagcagacatacagaataccactttcatcatcgatggcccagacactccagaatgccccgatgaccaaagagcatggaacatttgggaagtcgaggactatgggtttggaattttcacgacaaacatatggctgaaattgcgtgactcctacacccaaatgtgtgaccaccggctaatgtcagctgccatcaaggacagcaaggcagtccatgctgacatggggtattggatagaaagtgaaaagaacgagacctggaagctagcgagagcctctttcatagaagttaagacatgcatctggccacgatctcacactctatggagtaatggagttttggaaagtgaaatgataatcccaaagatatatggaggaccaacatctcagcacaactacagaccagggtatttcacacaaacagcagggccatggcacctaggcaagttggaattagattttgatctgtgtgaaggcaccacagttgttgtggatgaacattgtggaaatcgaggtccatctcttagaactacaacagtcacaggaaagataatccatgaatggtgttgcagatcctgcacattaccccccttacgcttcaaaggagaagacggatgttggtacggcatggaaatcagaccagttaaggagaaggaagagaacctagttaggtcaatggtctctgcagggtcaggagaagtggacagtttttcattgggactactatgcgtgtcaataatgattgaagaagtgatgagatccagatggagtagaaagatgctgatgactggaacactggctgttttcttccttctcataatggggcaactgacatggaatgatctgatcagggtatgcatcatggttggagccaatgtttcagacaggatggggatgggaacaacgtacctagccttgatggccactttcaaaatgagaccaatgttcgctgttgggctattatttcgcagactaacatccagagaagttcttcttcttacaatcggattaagcctggtggcatccgtggagctaccaaattctctagaggagctaggggatggacttgcaatgggcattatgatgttaaaattattgactgattttcagtcacaccagttatggactaccttactgtctctgacatttatcaaaacaaccctttcattggattacgcatggaagacaatggctatggtactgtcaatcatatctctctttcccttatgtctatctacgacctctcaaaaaacaacatggcttccggtgctgttaggatcttttggatgcaaaccactaaccatgtttcttataacagaaaacaaaatctggggaaggaaaagttggccccttaatgaaggaattatggctgttggaatagtcagcattctactaagttcactccttaaaaatgatgtgccactagctggcccactaatagctggaggcatgctaatagcatgttatgtcatatccggaagctcagccgatttgtcactggaaaaagctgctgaggtctcctgggaagaagaagcagaacactctggtgcctcacacaacatattggtagaggtccaagatgatggaaccatgaaaataaaagatgaagagagagatgacacgctcacaatactcctcaaagcaactctgctggcagtctcaggggtgtacccaatgtcaattccagcgaccctttttgtgtggtatttttggcagaaaaagaaacagagatcaggagtgttgtgggacacacccagccctccagaagtggaaagagcagttcttgatgatggtatctacagaatcttgcaaagaggactgttgggtaggtcccaagtaggagtgggagttttccaagacggcgtgttccacacgatgtggcacgtcactaggggagctgtcctcatgtaccaagggaagaggctggaaccaagttgggccagtgtcaaaaaagacttgatctcatatggaggaggctggaggtttcaaggatcatggaacacgggagaagaagtgcaggtgatagctgttgaaccagggaaaaaccccaaaaatgtacagacaacgccgggtaccttcaagacccctgaaggcgaagttggagccatagccctagacttcaaacccggcacatctggatctcccatcgtgaacagagagggaaaaatagtaggtctttatggaaatggagtagtgacaacgagtggaacctacgtcagtgctattgcccaagctaaagcatcacaagaagggcctctaccagaaattgaggacgaggtgttcaggaaaagaaacttaacaataatggacctgcatccaggatcaggaaaaacaagaagatatcttccagccatagtccgtgaggccataaaaaggaaactgcgcacgctaatcttggcccccacaagagttgtcgcctctgaaatggcagaggcgcttaagggaatgccaataagatatcaaacaacagcagtaaagagtgaacacacaggaagggagatagttgacctcatgtgccacgccactttcaccatgcgtctcctatctccagtgagagttcccaattacaacatgattatcatggatgaagcacattttaccgatccagccagcatagcggccagagggtacatctcaacccgagtgggtatgggtgaagcagctgcgatctttatgacagccacccccccaggatcggtggaggcctttccacagagcaatgcagttatccaagatgaggaaagagacattcctgagagatcatggaactcaggctacgactggatcactgattttccaggtaaaacagtctggtttgtcccaagcatcaaatcaggaaatgacattgccaactgtttaagaaagaacgggaaacgggtgatccaattgagcagaaaaacttttgacactgagtaccagaaaacaaaaaacaatgactgggactatgttgtcacaacagacatttccgaaatgggagcaaatttccgggccgacagggtaatagacccaaggcggtgtttgaaaccggtaatactaaaagatggtccagagcgcgttatcctagccggaccgatgccagtgactgtggccagtgctgcccagaggagaggaagaattggaaggaaccaaaacaaggaaggtgatcagtatgtttacatgggacagcctttaaacaatgatgaggaccacgctcattggacagaagcaaaaatgctccttgacaatataaacacaccagaagggattatcccagccctctttgagccagagagggaaaagagtgcagcaatagacggggagtacagactacggggagaagcaaggaaaacgttcgtggagctcatgaggagaggagatctaccagtttggctatcctacaaagttgcctcagaaggcttccagtattccgacagaaggtggtgctttgatggggaaaggaacaaccaagtgctggaggagaacatggacgtggagatctggacaaaggaaggagaaagaaagaaactacgacctcgctggttggatgccagaacatactctgatccactggcccttcgcgagttcaaagagtttgcagcaggaagaagaagtgtctcaggtgacctaatattagaaatagggaaacttccacaacatttgacgctaaaggcccagaatgctttggataacttggtcatgttgcataattccgaacaaggaggaaaagcctatagacatgcaatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgtactgttatggatggccagtgtggagccccattggatagcggcctccatcatattagagttctttttgatggtgctgctcattccagagccagacagacagcgcactccacaggacaaccagttagcatatgtggtgataggtttgttattcatgatactgacagtggcagccaatgagatgggattactggaaaccacaaagaaagacctggggatcggccatgtggttgccgaaaaccaccaccatgctacaatgctggacatagacctacatccagcctcagcctggaccctttatgcagtagccacaacaattatcactcccatgatgagacacacaattgaaaacacaacggcaaacatttctctgacagctattgcaaatcaggcggctatactgatgggacttgacaagggatggccaatatcgaagatggacataggagttccacttctcgccttagggtgctattcccaggtgaacccattgacactgacagcagcggtgttgatgctagtggctcattatgccataatcggacctggactgcaagcaaaagccactagagaagctcaaaaaaggacagcggccggaataatgaaaaatccaaccgtagacggaattgtcgcaatagacttggaccctgtggtttacgatgcaaaatttgaaaaacagctaggccaaataatgttactgatactttgcacatcacagattctcttgatgcggactacatgggccttatgtgaatccatcacactggctactggacccctgaccactctctgggagggatctccaggaaaattctggaataccacgatagcagtgtccatggcaaacatcttcagaggaagttacctagcaggagcaggtctggccttctcattaatgaaatctttaggaggagggaggagaggtacgggagctcaaggggaaacactgggagaaaaatggaaaagacagctaaaccaactgagcaagtcagaatttaacacctacaaaaggagtgggattatggaggtggatagatccgaagccaaggagggactaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgcgccgggctgaagaaggtcacagaagtgaagggatacacaaaaggaggacctggacatgaggaacctattccaatggcaacatatggatggaacctagtaaagctacactctggaaaagatgtgttcttcacaccacctgagaaatgtgatacccttttgtgtgatattggtgagtcctctccgaatccaactatagaagaaggaagaacgttacgtgttctgaagatggtggaaccatggctcagaggaaaccaattttgcataaaaatcctaaatccttacatgccaagtgtggtagagactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttgctgaaccgattcacaatggcccacaggaagccaacatatgaaagagatgtggacctaggcgctggaacaagacatgtgacagtggaaccagaggtagccaacctggatatcattggccagaggatagagaatataaaaaatgaacataagtcaacatggcattatgatgaggacaatccatacaaaacatgggcctatcatggatcatatgaggtcaagccatcaggatcagcctcttccatggtgaatggcgtggtgagactgctcaccaaaccatgggatgtcatccccatggtcacacaaatagctatgactgacaccacacccttcggacaacaaagggtgtttaaagagaaagttgacacgcgcacaccaagagcaaaacgaggcacagcacaaatcatggaagtgacagccaagtggttatggggtttcctttctagaaagaaaaaacccagaatctgcacaagagaggagttcacaagaaaagttaggtcaaatgcggctattggagcagtatttgttgatgaaaaccaatggaactcagcaaaagaagcagtggaagacgaaaggttctgggatcttgtgcacagagagagggagcttcataaacagggaaaatgtgccacgtgcgtctacaacatgatgggaaaaagagagaaaaagttgggagagtttggaaaagcaaaaggaagtcgtgcaatatggtatatgtggctgggagcacgctttctagagttcgaagcccttggcttcatgaatgaagatcactggttcagtagagagaattcactcagtggagtggaaggagaaggactgcacaaacttggatacatactcagagacatatcaaagattccagggggaaatatgtatgcagatgacacagctggatgggacacaagaataacagaggacgatcttcagaatgaggctaaaatcactgacatcatggaacctgaacatgctctattggctacgtcaatctttaagctgacctaccaaaataaggtggtaagggtgcaaagaccagcaaaaagtggaaccgtgatggatgtcatatctagacgtgaccagagaggaagcggacaggtcggaacttatggcttaaatactttcaccaacatggaggtccaactaataagacaaatggaatctgagggaatcttttcacccagcgaattggaaacccctaatctagcagagagagttctcgactggttggaaaaacatggcgtcgaaaggttgaaaaggatggcaatcagcggagatgactgcgtggtgaaaccacttgatgataggttcgcaacagccttaacagctctgaatgacatgggaaaagtaagaaaagacataccgcaatgggaaccttcaaaaggatggaatgactggcagcaagtgcctttctgctcacaccatttccaccaactgatcatgaaggatgggagggagatagtggtgccatgccgcaaccaagatgaacttgtgggcagggccagagtatcacaaggcgccggatggagcctgagagaaaccgcttgcctaggcaagtcatatgcacaaatgtggcagctgatgtacttccacaggagagacctgagactagcggctaatgctatctgttcagccgtcccagttgattgggttccaaccagccgcactacctggtcaatccatgcccaccatcaatggatgacaacagaagacatgttatcagtgtggaatagggtttggatagaggaaaacccatggatggaagacaaaactcatgtgcccagttgggaggatgttccttacttgggaaaaagggaagatcaatggtgtggatccttgataggcttgacagcaagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 67 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggccttcatagcattcctaagatttctagccatacccccaacagcaggaattttggctagatggggctcattcaagaagaatggagcgatcaaagtgctacggggtttcaagaaagaaatctcaagcatgttgaatataatgaatagaaggaaaagatctgtgaccatgctccttatgctgatgcctacagccttggcgttccatttgactacacgagggggagagccgcacatgatagtcagcaagcaggaaagaggaaaatcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggctccactcgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcattctgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgggcattgaagctaaaatatcaaacaccaccaccgactcaagatgtccaacacaaggagaagccacactggtggaagaacaagacgcgaactttgtgtgtcgacgaacgtttgtggacagaggctggggcaacggctgtgggctcttcggaaaaggaagcctaataacgtgtgctaagttcaagtgtgtgacaaaactggaaggaaagatagtacaatatgaaaacttgaaatattcagtaatagtcaccgtccacactggagaccagcaccaggtgggaaatgaaagcacagaacatgggacaactgcaactataacacctcaagctcctacaacggaaatacagctgaccgactacggagctcttacattggattgttcacctagaacaggactagactttaatgaaatggtgttgctgacaatgaaagaaaaatcatggctagtccacaaacaatggtttttagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagattcctttttcgacccaagatgaaaaaggagttacacagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattggtacaccagatttttggaactgcatatggagttttgttcagcggtgtttcctggaccatgaaaataggaataggggttctgctgacatggctaggattaaactcaagaagcacgtctctttcgatgacgtgcattgcagttggcctagtaacactatacttaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaagggaaaaagatgattaggccacaacccatggaatacaaatactcgtggaaaagctggggaaaggctaaaatcataggggcagatgtacagaacgccaccttcatcatcgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggatactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctctcaggaccacaacagtcacaggaaagataattcatgaatggtgttgcagatcttgtacgctaccacccttacgtttcagaggagaagatgggtgctggtacggtatggaaatcagaccagtcaaggaaaaggaagagaacctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctattattccgcagactaacatccagagaagttcttcttctaacaattggactgagtctagtggcatctgtggagttaccaaattgcttggaggagctgggggatggacttgcaatgggcattatgattttaaaattattgactgactttcaatcacatcagctgtgggctaccttgctgtgcttgacatttatcaaaacaacgttttccctgcactatgcatggaagacaatggctatggtactgtcaattgtatctctcttccccttatgcctgtccacgacctcccaaaaaacaacatggcttccggtgctactgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggccgaggtctcctgggaagaagaagcagaacactctggtgcctcacacaacatattagtggaggtccaagatgatggaaccatgaagataaaggacgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcaccttcaagacccctgaaggtgaagttggagctattgccctagattttaaacccggcacatctggatctcccatcgtgaacagagaaggaaaaatagtaggtctttatggaaatggagtagtgacaacaagtggaacctatgtcagtgccatagctcaagctaaagcatcacaagaagggcccctaccagagattgaagacgaggtgtttaggaaaagaaacttgacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcctgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatggaaaacgggtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgttattttagcaggaccgatgccagtgaccgtggccagtgccgcccagaggagaggaagaattggaaggaaccacaataaggaaggtgatcagtacatctacatgggacagcctttgaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgttcgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacatttgacgcaaagggcccagaatgccttggacaacctggttatgttgcacaactccgaacaaggaggaagagcctatagacatgcactagaagaactgccagacaccatagaaacgttgatgctcctagctttgatagctgtgttaactggtggagtgacgctgttcttcctatcaggaaggggcctagggaaaacatctattggcctactctgcgtgatggcttcaagcgtactgctatggatggccagtgtggagccccattggatagcggcctccatcatactggagttcttcctgatggtgctgctcgttccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgcctcaatgctggacgtagacttacacccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatctggaccctgtggtttatgatgcaaaatttgagaaacaactaggccaaataatgttgttgatactatgcacatcacagatcctcttgatgcggactacatgggccttgtgcgaatccatcacactggctactggacctctgaccacgctttgggagggatctccaggaaaattttggaacaccacgatagcggtttccatggcaaacattttcagaggaagttatctagcaggagcgggtctggccttctcattaatgaaatctctaggagggggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctacggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgttaaatcgattcacaatggctcacaggaagccaacatatgaaagagacgtggacctaggcgccggaacaagacatgtggcagtggaaccagaggtagccaacctagatatcattgggcagaggatagagaacataaaacatgaacataagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacacccttcggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacattatggaacccgaacatgccctactggctaagtcaatcttcaagctaacctaccaaaataaagtggtaagggtacagagaccagcaaaaaatggaaccgtgatggatgtcatatccagacgtgaccagagaggaagtggccaagtcggaacttatggcttaaacactttcaccaacatggaagcccagctgataagacaaatggagtctgagggaatcttttcacccagcgaattagagaccccaaatttagccgagagagttctctactggctggaaaaatatggcgtcgaaaggctgaaaagaatggcaatcagcggagatgactgcgtagtgaaaccaattgatgataggtttgcaatagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 68 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaactggtgatggcttttatagcattcctaagattcctagccatacctccaacagcaggaattttggctagatggggctcattcaagaagaatggagcgatcaaagtactacggggtttcaagaaagaaatctcaaacatgttaaacataatgaacaggaggaaaagatctgtgagcgtgctcttcatgctgctgcccacagccctggcgttccatctgactacccgagggggagagccgcacatgatagttagcaagcaggaaagaggaaagtcacttttgtttaagacctctgcaggtgtcaacatgtgtacccttattgcaatggatttgggagagttgtgtgaggacacaatgacctacaaatgcccccggatcactgaaacggaaccagatgacgttgactgttggtgcaacgccacggagacatgggtgacctatggaacatgttctcaaactggtgaacaccgacgagacaaacgttctgttgcactggcaccacacgtagggcttggtctagaaacaagaaccgaaacgtggatgtcctctgaaggcgcttggaaccaaatacaaaaagtggagacctgggctctgagacacccaggattcacggtgatagctctttttctagcacatgccataggaacatccattacccagaaaggaattattttcattttgctgatgctggtaactccatccatggccatgcggtgcgtgggaataggcaacagagacttcgtggaaggactgtcaggagctacgtgggtggatgtggtactggagcatggaagttgcgtcactacaatggcaaaaaacaaaccaacactggatattgaactcttaaagacggaggtcacaaacccagccatcctgcgcaaactgtgcattgaagccaaaatatcaaatactaccaccgattcgagatgtccaacacaaggagaagccacgctggtggaagaacaagacacgaactttgtgtgtcgacgaacgttcgtggacagaggctggggcaatggttgtgggctatttggaaaaggtagcttaataacgtgtgctaagtttaagtgtgtgacaaaattggaaggaaagatagtccaatatgaaaatttaaaatattcagtgatagtcaccgtccacactggagaccagcaccaagttgggaatgagactacagaacatggaacaactgcaatcataacacctcaagctcctacgtcggaaatacagctgacagactacggagctctaacactggactgttcacctagaacagggctagacttcaatgagatggtgttgttgacaatgaaagaaaaatcatggctcgtccacaaacaatggtttctagacttaccgctgccttggacctcgggggcttcaacatcccaagagacttggaatagacaagacttgctggtcacatttaagacagctcatgcaaagaagcaggaagtagttgtactaggatcacaagaaggagcgatgcacactgcgctgactggagcaacagaaatccaaacgtctggaacgacaacaattttcgcaggacacctgaaatgcagactgaaaatggataaactgactttaaaaggggtatcatatgtaatgtgcacagggtcattcaagctagaaaaggaagtggctgagacccagcatggaactgttctagtgcaggttaagtacgaaggaacagatgcaccatgtaagatccccttctcatcccaagatgagaagggagtaatccagaatgggagattgataacggccaaccccatagtcactgacaaagaaaaaccagtcaacattgaggcggagccaccttttggtgagagctacatcgtggtaggagcaggtgagaaagctttgaaactaagctggttcaagaagggaagcagtatagggaaaatgtttgaagcaactgcccgtggagcacgaaggatggccattctgggagacactgcatgggacttcggttctataggaggagtgttcacgtctgtgggaaaactggtacaccagatttttggaactgcgtacggagttttgttcagcggtgtttcttggaccatgaaaataggaatagggattctgttgacatggctaggattaaattcaaggagcacgtccctttcaatgacgtgtatcgcagttggcatggttacactgtacctaggagttatggttcaggcggactcgggatgtgtaattaactggaaaggcagagaactcaaatgtggaagcggcatttttgtcactaatgaagttcacacctggacagagcaatacaaattccaggccgactccccaaagagactatcagcagccatagggaaggcatgggaggagggtgtgtgtggaattcgatcagccactcgtctcgaaaacatcatgtggaagcaaatatcaaatgaattaaaccacatcttacttgaaaatgacatgaaattcacagtggtcgtaggagatgtcagtgggatcttggcccaaggaaagaaaatgattaggccacaacccatggaacacaaatactcgtggaaaagctggggaaaagccaagatcataggagcagatgtacagaacaccaccttcatcatcgacggcccaaacaccccagaatgccctgataaccaaagagcatggaacatctgggaagttgaagactatggatttggaattttcacgacaaacatatggttgaaattgcgtgactcttttactcaagtgtgtgaccaccggctaatgtcagctgccattaaggatagcaaagcagtccatgctgacatggggtactggatagaaagtgaaaagaacgagacttggaagttggcaagagcctccttcatagaagttaagacatgcatctggccaaaatcccacactctatggagcaatggagtcctggaaagtgagatgataatcccaaagacatatggaggaccagtatctcagcacaactacagaccaggatatttcacacaaacagcagggccatggcacttaggcaagttggaactagattttgatttgtgtgaaggtaccacagttgttgtggatgaaaattgtggaaatcgaggaccatctcttagaactacaacagtcacaggaaagacaatccatgaatggtgctgtagatcttgcacgttaccccctctacgtttcaaaggggaagacgggtgctggtacggcatggaaatcagaccagtcaaggagaaggaagagaacctagttaagtcaatggtttctgcagggtcaggagaagtggatagtctttcactaggactgctatgcatatcaataatgatcgaagaggtaatgagatccagatggagcagaaagatgctgatgactggaacattggctgtgttcctccttctcacaatgggacaattgacatggaatgatctgatcaggctatgtatcatggttggagccaatgcttcagacatgatggggatgggaacaacgtacctagctttgatggccactttcagaatgagaccaatgttcgcagtcggactcttatttcgcagattaacatctagagaaattcttcttcttacagttggattgagcctggtggcatctgtagaactaccaaattccttagaagagctaggggatggacttgcaatgggcatcatgatgttgaaattactgactgattttcagccacatcagctatgggctaccttgctgtctttaacatttgtcaaaacaactctgtcattgcactatgcatggaagacaatggccatgatactatcaattgtgtctctcctccctttgtgcctgtccacgacatctcaaaaaacgacatggcttccggtgctgctgggatctcttggatgcaaaccactaaccatgtttcttataacagaaaacaaaatttgggggaggagaagttggcccctcaatgaaggaattatggctattggaatagtaagcatcctactaagttcacttctcaaaaatgatgtgccactagctggcccactaatagctggaggcatgctaatagcatgttatgtcatatctggaagctcggccgacttatcactggagaaagcggctgaggtttcctgggaagatgaagcagaacactctggtgcctcacacaacatactagtggaggtccaagatgacggaaccatgaagataaaagatgaagagagagatgacacactcaccattctcctcaaagctactctgttagtaatctcaggggtatacccaatgtcaataccggcgactctctttgtgtggtatttttggcagaaaaagaaacagagatcaggagtgctatgggacacacccagccctccagaagtggaaagagcagtccttgacaatggcatttatagaattctccaaagaggattgttgggcaggtctcaagtaggagtaggagtttttcaagaaggtgtgttccacacaatgtggcacgtcaccaggggagctgttctcatgtaccaagggaagagattggaaccaagttgggctagtgtcaaaaaagacttgatctcatatggaggaggttggaggtttcaaggatcctggaacacgggagaagaagtgcaggtgattgctgttgaaccggggaagaaccccaaaaatgtacagacaacgccaggcaccttcaagacccctgaaggtgaagttggagctatagctctagacttcaagcccggcacatctggatctcctatcgtgaacagagagggaaaaatagtgggtctttatggaaatggagtggtgacaacaagtggaacctacgtcagtgccatagctcaagctaaagcatcacaagaagggcccctaccagagattgaggacgaggtgtttaggaaaaagaatttaacaataatggacctacatccaggatcagggaaaacaagaagataccttccagccatagtccgtgaggccataaaaagaaagctgcgcacgctagtcttggcccccacaagagttgtcgcttctgaaatggcagaagcgcttaagggaatgccaataaggtatcagacaacagcagtgaaaagtgaacacacgggaaaggagatagttgatcttatgtgtcacgccactttcactatgcgtctcctgtctcctgtgagagtccccaattacaacatgattatcgtggatgaagcacatttcaccgatccagccagcatagcagccagagggtacatctcaacccgagtaggtatgggtgaagcagctgcgatcttcatgacagccactccccccggatcggtggaggcctttccacagagcaatgcagttatccaagatgaggaaagagacattcctgaaagatcatggaactcaggctatgattggatcactgacttcccaggtaaaacagtctggtttgttccaagcatcaaatcaggaaatgacgttgccaactgtttaagaaagaatgggaaacgggtgatccaattgagcagaaaaacttttgacactgagtaccagaaaacaaaaaacaacgactgggactatgttgtcacaacagacatatccgaaatgggagcaaactttcgagccgacagggtaatagacccaaggcggtgcctgaaaccggtaatactgaaagatggtccagagcgtgtcattctagccggaccgatgccagtgactgtggctagtgccgcccagaggagagggagaattggaaggaaccaaaataaggtaggtgatcagtatgtttacatgggacagcctctaaataatgatgaggaccatgcccattggacagaagcaaaaatgctccttgacaacataaacacaccagaagggatcatcccagccctctttgagccggaaagagaaaaaagtgctgcaatagacggggaatacagactacggggtgaagcgaggaaaacgtttgtggagctcatgagaagaggagatctacctgtctggctatcttacaaagttgcctcagaaggcttccaatactccgacagaaggtggtgctttgatggggaaaggaacaaccaggtgttggaggagaacatggacgtggagatctggacaaaagaaggagaaagaaagaaactacgaccccgctggctggatgccagaacatattctgacccactggctctgcgcgaattcaaagagttcgcagcaggaagaagaagtgtctcaggtgacctaatattagaaatagggaaacttccacaacatttaacgctaaaagctcagaatgctttggataatctggtcatgctgcacaactctgaacaaggaggtaaagcctacagacacgccatggaagaactaccagataccatagaaacgttaatgctcctagctctgatagctgtgctgactggtggagtgacgctgttcttcctatcaggaagaggtctaggaaaaacatccattggcctactctgtgtgatggcctcaagtgtactgttgtggatggccagtgtggagcctcatcggatagcggcctctatcatgctggagttctttctgatggtgttgcttattccagagccagaccgacagcgcactccacaagacaaccagctagcatatgtggtgatagctttgttattcatgatattgacagtggcagccaatgagatgggattgttggaaaccacaaagaaagacctggggattggtcatgcagctgctgaaaaccaccaccatgctgcaatgctggacgtggacctacatccagcttcagcctggactctctatgcagtggccacaacaatcatcactcccatgatgagacacacaattgaaaacacaacggcaaatatttccctgacagctatcgcaaaccaggcagctatattgatgggacttgacaagggatggccaatatcaaagatggacataggagttccacttctcgccttggggtgctattctcaggtgaacccgctgacgctgacagcggcggtattgatgctagtggctcactatgccataattggacctggactgcaggcaaaagctactagagaagctcaaaaaaggacagcagctggaataatgaaaaacccaactgtcgacgggatcgttgcaatagatttggaccctgtagtttacgatgcaaaatttgaaaaacagctaggccaaataatgttgttgatactttgcacatcacagattctcctaatgcggaccacatgggccttgtgtgaatccatcacattggccactggacctctgaccacgctttgggagggatctccaggaaaattttggaacacaactatagcggtgtccatggcaaacattttcaggggaagttatctagcaggagcaggtttggccttttcattgatgaaatctttaggaggaggtaggagaggcacaggagccccaggagaaacgctgggagaaaaatggaaaagacagctaaaccaattgagcaaatcagaatttaacatttacaagaggagtgggattatagaggtggatagatttgaagccaaagaggggttgaaaagaggagaaacaaccaaacatgcagtgtcgagaggaacggccaaattgaggtggtttgtggaaaggaaccttgtgaaaccagaagggaaagtcattgacctcggttgtggaagaggtggctggtcatattactgcgctgggctgaagaaagtcacagaagtaaaaggatacacgaaaggaggacctggacatgaggaaccaatcccaatggcaacctatggatggaacctagtaaagctacactttggaaaagatgtattctttaccccccctgagaaatgtgacccccttttgtgtgatatcggtgagtcctctccaaacccaactatagaagaaggaagaacattacgtgttctaaagatggtggaaccatggctcagaggaaatcaattttgcataaaaattctaaatccctatatgccgagtgtggtagaaactctggagcaaatgcaaaggaaacatggaggaatgctagtgcgaaatccactctcaagaaactccactcatgaaatgtactgggtttcatgtggaacaggaaacattgtgtcagcagtgaacatgacatctagaatgctgctaaatcgattcacaatggctcacaggaagccaacatatgaaagagacgtggacttaggcgctggaacaagacatgtggcagtggaaccagaggtggccaacctagatatcattggccagaggatagagaatataaaaaatgaacacaaatcaacatggcattatgatgaggacaatccatacaaaacatgggcctatcatggatcatatgaggtcaagccatcaggatcagcttcatccatggtcaatggtgtggtgagactgctaaccaaaccatgggatgtcattcccatggtcacacaaatagccatgactgataccacaccctttggacaacagagggtgtttaaagagaaagttgatacgcgcacaccaaaagcgaaacgaggcacagcgcaaattatggaggtaacagccaggtggttatggggttttctctctagaaacaaaaaacccagaatctgcacaagggaggagtttacaagaaaagttaggtcaaacgcagccattggagcagtgttcgttgacgaaaatcagtggaactcagcaaaagaggcagtggaagatgaacggttttgggaccttgtgcacagagagagagagcttcataaacaaggaaaatgtgccacgtgtgtctacaacatgatgggaaagagagagaaaaaattaggagagttcggaaaggcaaaaggaagtcgcgcaatatggtacatgtggttgggagcgcgctttttagagtttgaagcccttggtttcatgaatgaagatcattggttcagcagagagaattcactcagtggagtggaaggagaaggactccacaaacttggatacatacttagagacatatcaaagattccagggggaaatatgtatgcagatgacacagccggatgggacacaagaataacagaggatgatcttcagaatgaggcaaaaatcactgacatcatggaacctgaacatgccctattggccacgtcaatctttaagctaacctaccaaaacaaggtagtaagggtgcagagaccagcaaaaaatggaaccgtgatggatgtcatatccagacgtgaccagagaggaagtggacaggttggaacctatggcttaaacaccttcactaacatggaggcccaactaataagacaaatggagtctgagggaatcttttcacctagcgaattggaaaccccaaacctagctgaaagagtcttcgactggttggaaaaacatggcatcgagaggctgaaaagaatggcaatcagtggagatgactgtgtggtgaaaccaattgatgacagatttgcaacagccttaacagccttgaatgacatgggaaaggtaagaaaagacataccgcaatgggaaccctcaaaaggatggaacgattggcaacaagtgcctttttgttcacaccatttccaccagctgattatgaaggatgggagggagatagtggtgccatgccgcaaccaagatgaacttgtgggtagggccagagtctcacaaggcgccggatggagcttgagagaaactgcatgcctaggcaagtcatatgcacaaatgtggcagctgatgtacttccacaggagagatttgagactagcggctaatgccatctgttcagccgttccagttgactgggtcccaaccagccgcaccacctggtcgatccatgcccaccatcaatggatgacaacagaagacatgttgtcagtgtggaatagggtttggatagaggaaaacccatggatggaggacaagactcatgtgtccagttgggaagacgttccatacctaggaaaaagggaagatcaatggtgtggatccctaataggcttaacagcacgagccacctgggccaccaacatacaagtggccataaaccaagtgagaaggctcattgggaacgagaactatctagactatatgacatcaatgaagagattcaaaaacgagagtgatcctgaaggagcactctggtga

SEQ ID NO: 69 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaactggtgatggcttttatagcattcctaagatttctagccatacctccaacagcaggaattttggctagatggggctcattcaagaagaatggagcgattaaagtgttacggggtttcaaaaaagaaatctcaaacatgttgaacataatgaacaggaggaaaagatctgtgaccatgctcctcatgctgctgcccacagccatgacgttccatctgaccacccgagggggagagccacacatgatagttagcaagcaggaaagaggaaagtcacttttgtttaagacctctgcaggtgtcaacatgtgtacccttattgcgatggatttgggagagttatgtgatgacacgatgacctacaaatgcccccggatctctgagacggaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggacgtcctctgaaggcgcttggagacaaatacaaaaagtggagacatgggctctgagacacccaggattcacggtgatagccctttttctagcacatgccataggaacatccatcacccagaaagggattattttcattttgctgatgctggtaactccatctatggccatgcggtgcgtgggaataggaaacagagacttcgtggaaggactgtcaggagctacgtgggtggatgtagtactggagcatggaagttgcgtcactaccatggcaaaagacaaaccaacactggacattgaactcttgaagacggaggtcacaaaccctgccgtcctgcgcaaactgtgcattgaagctaaaatatcaaataccaccactgactcgagatgtccgacacaaggagaagccacgctggtggaagaacaagacacgaactttgtgtgtcgacgaacgttcgtggacagaggctggggcaatggttgtggactattcggaaaaggtagcttaataacgtgtgctaagtttaagtgtgtgacaaaattggaaggaaagatagtccaatatgaaaacttaaaatattcagtgatcgttaccgtccacactggagaccagcaccaagttggaaatgagaccacagaacatggaacaattgcaaccataacacctcaagctcccacgtcggaaatacaattgacagactacggagctctaacactggactgttcacctagaacagggctagactttaatgagatggtgttgttgacaatgaaagaaaaatcatggctcgtccacaaacaatggtttctagacttaccactgccttggacctcaggggcctcaacatcccaagagacttggaacagacaagacttgctggtcacatttaagacagctcatgcaaagaagcaggaagtagtcgtactaggatcacaagaaggagcaatgcacactgcgttgaccggagcgacagaaatccaaacgtctggaacgacaacaatttttgcaggccacctgaaatgcagactaaaaatggataaactgactttaaaaggaatatcatatgtaatgtgcacaggcccatttaagttagagaaggaagtggctgagacccagcatggaactgttctagtacaggttaaatacgaaggaacagatgcaccatgcaagatccccttttcgtcccaagatgagaagggagtaacccagaatgggagattggtaacagccaaccccatagtcactgacaaagaaaaaccagtcagcattgaggcggaaccaccttttggtgagagctacatcgtggtaggagcaggtgaaaaagccttgaaactaagctggttcaagaagggaagcagtatagggaaaatgtttgaagcaactgcccgtggagcccgaaggatggccatcctgggagacaccgcatgggacttcggttctataggaggagtgttcacgtctgtgggaaaactggtacaccagatttttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtcaccaatgaagttcacacctggacagagcaatacaaattccaggccgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtcgtgggagacgttagtggaatcttggcccaaggaaagaaaacgattaggccacaacccatggaacacaaatactcgtggaaaagctggggaaaagccaaaatcattggagcagatgttcagaacactaccttcatcatcgacggcccaaacaccccagaatgccctgatgaccaaagagcatggaacatctgggaagttgaagactatggatttggaattttcacgacaaacatatggttgaaattgcgtgactcctacacccaagtgtgtgaccatcgattaatgtcagctgccatcaaggatagcaaagcagtccatgctgacatggggtactggatggaaagtgaaaagaacgagacttggaagttggcaagagcctccttcatagaagtcaagacatgcatttggccaaaatctcacactctatggagcaatggagtcctggaaagtgagatgataatccccaagatatatggaggaccaatatctcagcacaattacagaccaggatatttcacacaaacagcagggccgtggcacttaggcaagttggaactagattttgatttgtgtgaaggtactacagttgttgtggatgaacattgtggaaatcgaggaccatctcttagaaccacaacagtcacaggaaagataatccatgaatggtgctgtagatcttgcacgttaccccccctacgtttcaaaggagaagacgggtgctggtacggcatggaaatcagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggctgtgttcctccttctcacaatgggacaattgacatggaacgacctgatcaggctatgcatcatggttggagccaatgcttcagataatatggggatgggaacaacgtacttagctttgatggccactttcagaatgagaccaatgttcgcagtcgggctattatttcgcagattaacatctagagaagttcttcttctcacggttggattgagtctggtggcatctgtagaattaccaaattccttagaggagctaggggatggatttgcaatgggcatcatgatattaaaattactgactgattttcaatcacatcagctatgggccaccttgctgtctctaacatttgtcaaaacaactttttcattgcactacgcatggaagacaatggctatgatactgtcaatcgtatctctcttcccttcttgcctgtccacgacttctcaaaaaacgacatggcttccggtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactggctggcccattaatagctggaggcatgctaatagcatgttatgtcatatccggaagctcggccgatttatcactggagaaagcggctgaggtctcctgggaagaagaagcagaacactctggcgcctcacacaatatactagtggaggtccaagatgatggaaccatgaagataaaggatgaagagagagatgacacgatcaccatcctcctcaaagcaaccctgctagcaatctcaggggtatatccaatgtcaataccggcgactccctttgtgtggtatttttggcagaaaaagaaacagagatcaggagagctatgggacacacctagccctccagaagtggaaagagcagtccttgatgatggtatttatagaattctccaaagaggattgttgggcaggtctcaggtaggagtaggagttttccaagaaggcgtattccacacaatgtggcacgtcaccaggggagctgttctcatgtatcaagggaagagattggaaccaagttgggctagtgtcaaaaaagacttgatctcatatggaggaggttggaggtttcaaggatcctggaacacgggagaagaagtgcaggtgattgctgttgaaccggggaagaacccaaaaaatgtacagacagcgccgggtaccttcaagacctctgaaggcgaagttggagccatagctctagactttaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttttggctcccacaagagttgtcgcctctgaaatggcagaggcgcttaagggaatgccaataaggtatcagacaacagcagtgaagagtgaacacacgggaaaggagatagttgaccttatgtgtcacgccactttcactatgcgtctcctgtctcctgtgagagttcccaattataacatgataatcatggatgaagcacatttcaccgatccagccagcatagcagccagagggtacatctcaacccgagtgggtatgggtgaagcagctgcgattttcatgacagccactccccccggatcggtggaggcctttccacagagcaatgcagttatccaagatgaggaaaaagacattcctgaaagatcatggaactcaggctatgattggatcactgacttcccaggtaaaacagtctggtttgttccaagcatcaaatcaggaaatgacattgccaactgtttaagaaagaatgggaaacgggtgatccaattgagcagaaaaacttttgacactgagtaccagaaaacaaaaaacaacgactgggactatgttgtcacaacagacatatccgaaatgggagcaaactttcgagccgacagggtaatagacccaaggcggtgcctgaaaccggtaatactgaaagatggtccagagcgtgtcattctagccggaccgatgccagtgactgtggctagtgccgcccagaggagaggaagaattggaaggaaccaaaataaggaaggtgatcagtatgtttacatgggacagcctctaaataatgatgaggaccatgcccattggacagaagcaaaaatgctccttgacaacataaacacaccagaagggatcatcccagccctctttgagccggaaagagaaaaaagtgctgcaatagacggggaatacagactacggggtgaagcgaggaaaacgtttgtggagctcatgagaagaggagatctacctgtctggctatcttacaaagttgcctcagaaggcttccaatactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagagatagggaaacttccacaacatttaacgcaaagggcccagaatgctttggacaatctggttatgctgcacaactctgaacaaggaggaaaagcttatagacacgccatggaagaattgccagacaccatagagacgttaatgctcctagctttgatagctgtgctgactggtggagtgacactattcttcctatcaggaagaggcctagggaaaacatccatcggcctactctgcgtgatgtcctcaagtgcactgttgtggatggccagtgaggagccccattggatagcggcctctatcatactggagttctttctgatggtgttgcttattccagagccagacagacagcgcactccacaagacaaccagttagcatatgtggtgataggtttgctattcgtgatattgacagtggcagcgaatgagatgggattattggaaaccacaaagaaagacctggggattggtcatgcagccgctgaaaaccaccaccacgccgcaatgctggacgtagacctacatccagcttcagcctggactctctatgcagtggccacaacgattatcactcccatgatgagacacacaattgaaaacacaacggcaaatatttccctgacagctattgcaaaccaggcagctatattgatgggacttgataagggatggccaatatcaaagatggatataggagttccacttctcgccttggggtgctattctcaggtgaacccgctgacgctgacagcggcggtactgatgctagtagctcattatgccataattggaccaggactgcaagcaaaagccactagagaagctcaaaaaaggacagcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacattttcagggggagttatctagcaggagcgggtctggccttctcattaatgaaatctctaggaggaggtaggagagggacgggagcccaaggggaaacactgggagaaaagtggaaaagacagctaaaccaattgagcaagtcagaattcaacacttacaagaggagtggtattatagaggtggatagatctgaagccaaggaggggttgagaagaggagaaacaaccaaacacgcagtgtcgagaggaacggccaaactgaggtggtttgtggagaggaatcttgtgaaaccagaagggaaagtcatagacctcggttgtggaagaggtggctggtcatattattgcgctgggctgaagaaagtcacagaagtgaaaggatacacaaaaggaggacctggacatgaggaaccaatcccaatggcagcctatggatggaacctagtaaagctacactccgggaaagatgtgttctttataccacctgagaagtgtgacacccttttgtgtgatattggtgagtcctctccaaacccgactatagaagaaggaagaacgttacgcgttctaaagatggtagaaccatggctcagaggaaaccaattttgcataaaaattctaaacccctatatgccgagtgtggtagaaactctggagcaaatgcaaagaaaacatggaggaatgctagtgcgaaatccactctcaagaaactccactcatgaaatgtactgggtttcgtgtggaacaggaaacattgtgtcagcagtaaatatgacatctagaatgctgctaaatagattcacaatggctcacaggaagccaacatatgaaagagatgtggacttgggcgctggaacaagacatgtggcagtagaaccagaggtggccaacctagacatcattggccagaggatagagaatataaaaaatgaacacaaatcaacatggcactatgatgaggacaatccgtacaaaacatgggcctatcatggatcatatgaggtcaagccatcaggatcagcctcatccatggtcaatggtgtggtgagactgctaaccaaaccatgggatgttatccccatggtcacacaaatagccatgactgacaccacaccctttggacaacaaagggtgtttaaagagaaagttgacacgcgtacgccaaaagcgaaacgaggcacagcacaaattatggaggtgacagccaggtggttatggggtttcctctctagaaacaaaaaacccagaatctgcacaagagaggagttcacaagaaaagtcaggtcaaatgcagctattggagcagtgttcgttgatgaaaatcaatggaactcagcaaaagaggcagtggaagatgaaaggttctgggaccttgtgcgcagagagagggagcttcataaacaagggaaatgtgccacgtgtgtctacaacatgatgggaaagagagagaaaaaattaggagagttcggaaaggcaaaaggaagtcgcgcaatatggtacatgtggttgggagcgcgcttcttagagtttgaagcccttggcttcatgaatgaagatcactggttcagcggagagaattcactcagtggagtggaaggagaaggactccacaaacttggatacatactcagagacatatcaaagattccagggggaaatatgtatgcagatgatacagccggatgggacacaagaataacagaggatgatcttcagaatgaggccaaaatcactgacatcatggaacctgaacatgccctactggccacgtcaatctttaagctaacctaccaaaacaaggttgtaagggtgcagagaccagcaaaaaatggaaccgtgatggatgtcatatccaggcgtgaccagagaggaagtggacaggttggaacttatggcttaaacaccttcaccaatatggaggcccaactaataagacaaatggagtctgagggaatcttttcacccagcgaattggaaaccccaaatttagccggaagagtccttgactggttggaaaaacatggcatcgagaggctgagaagaatggcaatcagtggagatgactgtgtggtgaaaccaattgatgacagatttgcaacagccttaacagccttgaatgacatgggaaaggtaagaaaggacataccgcaatgggaaccttcaaaaggatggaatgattggcaacaagtgcctttctgctcacaccacttccaccagctgattatgaaggatgggagggagatagtggtgccatgccgcaaccaagatgaactggtaggtagggccagagtatcacaaggcgccggatggagcttgagagaaactgcatgtctaggcaagtcgtatgcacaaatgtggcagctgatgtacttccacaggagagacttgagattagcggctaatgctatctgttcagccgttccagttgattgggtcccaaccagccgcaccacctggtcgatccacgcccaccatcaatggatgacaacagaagacatgttgtcagtgtggaatagggtttggatagaggaaaacccatggatggaggataaaactcatgtgtccagctgggaagacattccatatctagggaaaagggaagatcaatggtgtggatccctaataggcttaacagcacgagctacctgggccaccaacatacaagtggccataagccaagtgagaaggctcattgggaatgaaaattatctagactacatgacatcaatgaagagattcaaaaacgagagtgatcccgaaggggcactctggtaa

SEQ ID NO: 70 - DNA, 10179 bp, Dengue virus
atgaacaaccaacggaagaagacgggtcgaccgtctttcaatatgctgaaacgcgcgagaaaccgcgtgtcaactggttcacagttggcgaagagattctcaaaaggattgctctcaggccaaggacccatgaaattggtgatggcttttatagcattcctaagatttctagccatacccccaacagcaggaattttggctagatggagctcattcaagaagaatggagcgatcaaagtgttacggggtttcaaaaaagagatctcaagcatgttgaacataatgaacaggagaaaaagatccgtgaccatgctccttatgctgctgcccacagccctggcgttccatttgaccacacgagggggagagccacacatgatagtcagcaagcaggaaagaggaaagtcactcttgtttaagacctctgcaggtgtcaacatgtgcaccctcattgcaatggatttgggagagttatgtgaggacacaatgacctacaaatgcccccggatcactgaagcggaaccagatgatgttgattgctggtgcaatgccacagacacatgggtgacctatgggacgtgttctcaaactggcgaacaccgacgggataaacgttctgtcgcattggccccacacgtagggcttggtctagaaacaagaaccgaaacgtggatgtcctctgaaggcgcctggagacagatacaaaaagtggagacttgggccttgagacacccaggattcacggtgatagccctttttttagcgcataccataggaacatccatcacccagaaagggatcatcttcattttgctgatgctggtgacaccatcaatggccatgcgatgcgtgggaataggcaacagagacttcgttgaaggactgtcaggagcaacgtgggtggatgtggtactggagcatggaagctgcgtcaccaccatggcaaaaaataaaccaacattggacattgaactcttgaagacggaggtcacgaaccctgccgtcttgcgcaaactgtgcattgaagctaaaatatcaaacaccactaccgattcaagatgcccaacacaaggagaagctacactggtggaagaacaagacgcgaactttgtgtgtcgacgaacattcgtggacagaggctggggtaatggttgtggactattcgggaaaggaagcttactgacgtgtgctaagtttaagtgtgtgacaaaacttgaaggaaagatagttcaatatgaaaacttaaaatattcggtgatagtcactgtccacactggggaccagcaccaggtgggaaatgagaccacagaacatggaacaattgcaaccataacacctcaagctcccacgtcggaaatacagctgactgactacggagccctcacattggactgctcacctagaacagggctggacttcaatgagatggtgctgttgacaatgaaagaaaaatcatggcttgtccacaaacaatggtttttagacttgccactgccttggacctcgggggcttcaacatctcaagagacttggaacagacaagatttgctggttacatttaagacagctcatgcgaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagttagagaaggaagtggctgagacccagcatggaaccgtcctagtgcaggttaaatacgaaggaacagatgcaccatgcaagattcccttttcaacccaagatgagaaaggagtgacccagaatgggagattgataacagccaatcccatagttactgacaaagaaaaaccagtcaacattgagacagaaccaccttttggtgagagctacatcgtgataggggcgggtgaaaaagctttgaaactaagctggttcaagaaaggaagcagcatagggaaaatgttcgaagctaccgcccgaggagcccgaaggatggctatcctgggagacacagcatgggacttcggttccataggaggggtgttcacatctgtgggaaaattggtacaccaggtttttggaaccgcatatggggtcttgttcagcggtgtttcttggaccatgaaaataggaatagggatcctgctgacatggctaggattaaattcaaggagcacgtcactctcgatgacgtgcattgtagttggcatggtcacactgtacctaggagtcatggttcaagcggactcggggtgtgtaatcaactggaagggcagagaactcaaatgcggaagtggcatcttcgtcactaatgaagtccacacttggacagagcaatataaattccaggctgactccccaaaaagactgtcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgctaatggaatcttgacccaaggaaaaaagatgattaggccacaacccatggaacacaaatactcatggaaaagctggggaaaagccaaaatcataggagcagatatacagaacaccaccttcatcattgatggcccagacactccagaatgccccgatgaccagagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttgatttgtgtgaaggcaccacagttgttgtggatgaacattgtggaaatcgaggtccttctcttagaactacaacagtcacaggaaagataatccatgaatggtgttgcagatcctgcacgctaccccccttacgcttcaaaggagaagacggatgttggtatggcatggaaatcagaccagttaaagagaaggaagagaatctagtcaggtcaatggtctctgcagggtcaggagaagtggacagtttttcattgggactactatgcgtatcaataatggttgaagaagtgatgagatccagatggagtagaaagatgctgatgactggaacactggctgttttcttccttcttataatgggacaactgacatggaatgatctgatcaggttatgcatcatggttggagccaatgtctcagacaggatggggatgggaacaacgtacctagccttgatggccactttcaaaatgagaccgatgttcgctgttgggctattatttcgcagactaacatccagagaggttctccttctcacaattggactaagcctggtggcatccgtggagctaccaaattctttagaggagctaggggacggacttgcaatgggcatcatgatgttaaaattgttgaccgattttcagtcacaccagttatggactaccttactgtctctgacatttatcaaaacaactctttcattggattatgcatggaagacaatagctatggtattgtcaatcgtatctctctttcctttatgtctatctacgacctctcaaaaaacaacatggcttccggtgctgttaggatcttttggatgcaaaccactaaccatgtttcttataacagaaaacaaaatctggggaaggaaaagttggcccctcaatgaaggaattatggctgttggaatagtcagtattctactaagttcactcctcaaaaatgatgtgccactagccggcccactaatagctggaggcatgctaataacatgttatgtcatatccggaagctcagccgatttatcattggagaaagcggctgaggtttcctgggaagaagaagcagaacactctggtgcctcacacaatatactagtggaggtccaagatgatggaactatgaaaataaaagatgaagagagagatgacacgctcaccatactccttaaagcaactctgttggcagtctcaggggtgtacccaatgtcaataccagcaaccctttttgtgtggtatttttggcagaaaaagaaacagagatcaggagtcttgtgggacacacctagccctccagaagtggaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccaggaaaaaacccaaaaaatgtacagacaacgccgggcaccttcaagacccctgaaggcgaagttggagccatagccctagatttcaaacccggcacatctggatctcccatcgtgaacagagagggaaaaatagtaggtctttatggaaatggagtggtgacaacaagtggaacttacgtcagtgccatcgcccaagccaaagcatcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaagggagatagttgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgtttaagaaagaacgggaaacgggtgatccaattgagcagaaaaacctttgacactgaataccagaaaacaaaaaacaatgactgggactatgttgtcacaacagacatttccgaaatgggagcaaatttccgggctgacagggtaatagacccaaggcggtgcttgaagccggtaatactaaaagatggcccagagcgcgtcattctagctggaccaatgccagtgaccgtggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaacacgccagaagggattatcccagccctctttgagccggagagagaaaagagtgcagcaatagacggggagtacagactgcggggagaagcaaggaaaacgttcgtggagttaatgagaagaggggatctaccagtttggctatcttacaaagttgcctcagaaggcttccagtactccgacagaaggtggtgctttgacggggaaaggaacaaccaggtgttggaggagaacatggacgtggagatctggacaaaagaaggagaaagaaagaaattacgacctcgctggttagatgccagaacctactctgatccactggccctgcgcgagtttaaagagttcgcagcaggaagaagaagtgtctcaggtgacctaatattagaaatagggaaacttccacagcatttgacgctaagggcccagaatgctttggacaacttggtcatgttgcacaattccgaacaagggggaaaagcttatagacatgctatggaagaattaccagacaccatagaaacattgatgctcctagctttgatagctgtgctgactggtggagtgacgttgtttttcctatcaggaaaaggtctagggaaaacatccattggcctactttgtgtgatggcctcaagtgtactgttatggatggccagtgtggagccccattggatagcggcctccatcatactagagttctttctgatggtgctgctcattccagagccagacagacagcgtactccacaggacaatcagctagcatatgtggtgataggtttgttattcatgatattgacagtggcggccaatgagatgggattactggaaaccacaaagaaagacctggggattggccatgcagtcgccgaaaaccaccaccatgcaacaatgctagacatagacctacatccagcttcagcctggaccctctatgcagtagccacaacaattatcactcccatgatgagacacacaattgaaaacacaacggcaaatatttccctgacagctattgcaaatcaggcggctatattgatgggacttgacaagggatggccaatatcgaagatggacataggagtgccacttctcgctttagggtgctattcccaggtgaacccattgacactgacagcagcggtgttgatgttagtggctcattatgccataatcggacctggactgcaagcaaaagccactagagaagcccaaaaaaggacagcggccggaataatgaaaaatccaactgtagacgggattgttgcaatagatttggatcctgtggtttatgatgcaaaatttgaaaaacagctaggccaaataatgttactgatactttgtacatcacagattctcttgatgcggactacatgggccttatgtgaatccatcacactggctactggacccttgaccactctctgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatctgaagccaaggagggactgaaaagaggagaaacaaccaaacatgcagtgtcgagaggaacagccaaacttaggtggtttgtggagaggaaccttgtgaaaccagaagggaaagtgatagacctcggttgtggaagaggtggctggtcatattattgcgctgggctgaagaaggttacagaagtgaagggatacacaaaaggaggacccggtcatgaggaacctatcccaatggcgacttatggatggaacctagtgaagctacactccggaaaagatgtattctttacaccacctgagaaatgtgacacccttttgtgtgacattggtgagtcctctccgaatccaaccatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacatcgtgtcggcagtgaacatgacatctagaatgttgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacacaagtcaacatggcattatgatgaggacaatccatacaaaacatgggcctatcatggatcatatgaggtcaagccatcagggtcagcctcatccatggtgaatggcgtggtgagattgctcaccaaaccatgggatgttatccccatggtcacacaaatagctatgactgataccacacccttcggacaacagagggtgtttaaagagaaagttgacacacgcacaccaagaccaaaacgaggcacagcacaaattatggaggtgacagccaagtggttgtggggtttcctctctagaaacaaaaaacccagaatctgcacaagagaggagttcacaagaaaagtcaggtcaaacgcagcaattggagcagtgttcgttgatgaaaaccaatggaactcagcaaaagaagcagtggaagacgaaaggttttgggacctcgtgcatagagagagggagcttcataaacagggaaaatgcgccacatgtgtctacaatatgatggggaaaagagagaaaaaattaggagagtttggaaaggcaaaaggaagtcgtgcaatatggtacatgtggttgggagcacgctttctagagtttgaagcccttggcttcatgaatgaagaccactggttcagtagagagaattcactcagtggagtggaaggagaaggactacacaaacttggatacatactcagagacatatcaaagattccagggggaaatgtgtatgcagatgacacagctggatgggacacaagaataacggaggatgatcttcagaatgaggctaaaatcactgacatcatggagcccgaacatgctctactggctacgtcaatcttcaagctgacctatcaaaataaggtggtaagggtgcaaagaccagcaaaaagtggaaccgtgatggatattatatccagacgtgaccagagaggaagtggacaggtcggaacttatggcttaaatactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaagtgagaaaagacataccacaatgggaaccttcaaaaggatggaatgactggcaacaagtgcctttctgttcacaccatttccaccaactgatcatgaaagatgggagggagatagtggtgccatgccgcaaccaagatgaacttgtgggcagggccagagtatcacaaggcgccggatggagcctgagagaaactgcttgcctaggcaagtcatatgcacaaatgtggcagctgatgtacttccacaggagagacctgagactagcggccaatgctatctgttcagccgttccagttgattgggtcccaaccagccgcaccacctggtcgatccatgcccaccaccaatggatgacaacagaagacatgttatcagtgtggaatagggtttggatagaggaaaacccatggatggaggacaaaactcatgtatccagttgggaagatgttccatacttaggaaaaagggaagatcaatggtgtggatccctgataggcttaacagcaagggccacctgggccaccaacatacaagtggccataaaacaagtgagaaggctcattgggaatgagaattatttagactacatgacatcaatgaagagattcaagaatgagagtgatcccgaaggagccctctggtaa

SEQ ID NO: 71 - DNA, 10179 bp, Dengue virus
  misc_feature (7888)..(7888): n is a, c, g, or t
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaactggtgatggcttttatagcattcctaagatttctagccatacctccaacagcaggaattttggctagatggggctcattcaagaagaatggagcgattaaagtgttgcggggtttcaaaaaagaaatctcaaacatgttgaacataatgaacaggaggaaaagatctgtgaccatgctcctcatgctactgcccacagccctgacgttccatctgaccacccgagggggagagccgcacatgatagttggcaagcaggaaagaggaaagtcatttttgtttaagacctctgcaggtgtcaacatgtgtacccttattgcaatggatctgggagagttatgtgatgacacgatgacctacaaatgcccccggatcactgagacggaaccagatgacgttgactgttggtgcaatgccacggagacatgggtgacctatggaacatgttctcaaaccggtgaacaccgacgagacaaacgttccgttgcactggcaccacacgtagggcttggtctggaaacaagaaccgaaacgtggatgtcctctgaaggcgcttggagacaaatacaaaaagtggagacatgggccctgagacacccaggattcacggtgatagccctttttctagcacatgccatagggacatccatcacccagaaagggattattttcattctgctgatgctggtaactccatccatggccatgcggtgcgtgggaataggaaacagagacttcgtggaaggactgtcaggagctacgtgggtggatgtagtactggagcatggaagttgtgtcactaccatggcaaaagacaaaccaacactggacattgaactcttgaagacggaggtcacaaaccctgccgtcttgcgcaaactgtgcattgaagccaaaatatcaaatactaccactgattcgagatgtccgacacaaggagaagccacgttggtggaagaacaagacacgaactttgtgtgtcgacgaacgttcgtggacagaggctggggcaatggttgtggactattcggaaaaggtagcttaataacgtgtgctaagtttaagtgtgtgacaaaattggaaggaaagatagtccaatatgaaaacttaaaatactcagtgatcgttaccgtccacactggagaccagcaccaagttggaaatgagaccacagaacatggaacaattgcaaccataacacctcaagctcccacgtcggaaatacaactggcagactacggagctctgacactggactgttcacctagaacagggctagactttaatgagatggtgttgttgacaatgaaagaaaaatcatggctcgtccacaaacaatggtttctagacttaccactgccttggacttcaggggcttcaacatcccaagagacttggaatagacaagacttgctggtcacatttaagacagctcatgcaaagaagcaggaagtagtcgtactaggatcacaagaaggagcaatgcatactgcgttgactggagctacagaaatccaaacgtctggaacgacaacaatttttgcaggccatctgaaatgcagactaaaaatggacaaactgactctaaaaggaatatcatatgtaatgtgcacaggctcattcaagttagagaaggaagtggctgagacccagcatggaactgttctagtacaggttaaatacgaaggaacagatgcaccatgcaagatccccttctcgtcccaagatgagaagggagtaacccagaatgggagattggtaacggccaaccccatagtcactgacaaagaaaaaccagtcaatattgaggcggagccaccttttggtgagagttacatcgtggtaggagcaggagaaaaagctttgaaactaagctggttcaagaagggaagcagcatagggaaaatgtttgaagcaactgcccgtggagcacgaaggatggccatcttgggagacaccgcatgggacttcggttctataggaggagtgttcacgtctgtgggaaaactggtacaccagatttttggaactgcgtatggagtcttgttcagtggtgtctcttggaccatgaaaataggaatagggattctgctgacatggctgggattaaactcaaggagcacgtctctttcaatgacgtgtatcgcagttgggctgatcacactgtacctaggagtcatggtccaggcggactcgggatgtgtgatcaactggaaaggcagagaactcaaatgtggaagcggcatttttgtcaccaatgaagttcacacctggacagagcaatacaaatttcaggccgactccccaaagagactatcagcagccattgggaaggcatgggaggaaggtgtgtgtggaattcgatcagccacccgtctcgagaacatcatgtggaagcaaatatcaaatgaattaaaccacatcttacttgaaaatgacatgaaatttacagtggtcgtaggagacgttagtggaatcttggcccaaggaaagaaatcgattaggccacaacccatggaacataaatactcgtggaaaagctggggaaaagccaaaatcattggagcagatgttcagaacactactttcatcatcgacggcccaaacaccccagaatgccctgatgaccaaagagcatggaacatctgggaagttgaagactatggatttggaattttcacgacaaacatatggttgaaattgcgtgactcctacacccaagtgtgtgaccatcgactaatgtcagctgccatcaaggatagcaaagcagtccatgctgacatggggtactggatagaaagtgaaaagaacgagacttggaagttggcaagagcctccttcatagaagtcaagacatgcatctggccaaagtctcacactctgtggagcaatggagtcctggaaagtgagatgataatcccaaagatatatggaggaccaatatctcagcataattacagaccaggatatttcacacaaacagcaggaccgtggcacttaggcaagttggaactagattttgatttgtgtgaaggtaccacagttgttgtagatgaacactgtggaaatagaggaccatctcttagaaccacaacagtcacaggaaagataatccatgaatggtgctgtagatcttgcacgttaccccccctacgtttcaaaggagaagacgggtgctggtatggcatggaaatcagaccagtcaaggagaaggaagagaacctagtcaagtcaatggtctctgcagggtcaggagaggtggacagtttttcactaggactgttgtgcatatcaataatgatcgaagaggtaatgagatccagatggagcaggaaaatgctgatgactggaacattggctgtgttcctccttctcacaatgggacaattgacatggaacgatctaatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagaggagctaggggatggacttgcaatgggcatcatgatattaaaattactaactgattttcaatcacatcagctatgggccaccttgctgtctctgacatttgtcaaaacaaccttttcattgcactacgcatggaagacaatggctatgatactgtcaattgtatctctcttccctttatgcctgtccacgacttctcaaaaaacaacatggcttccggtgcttctggggtctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcgtgttatgtcatatccggaagctcggccgatttatcactggagaaagcggctgaggtctcctgggaagaagaagcagaacactctggtgcctcacacaacatactagtggagatccaagatgatggaaccatgaagataaaagatgaagagagagatgacacgatcaccatcctcctcaaagcaaccttgctagcaatctcaggggtatacccaatgtcaataccggcgactctctttgtgtggtatttttggcagaaaaagaaacagagatcaggagtgctatgggacacaccaagccctccagaagtggaaagagcagtccttgatgatggcatttatagaattctccaaaggggattgttgggcaggtctcaagtaggagtaggagttttccaagaaggcgtattccacacaatgtggcatgtcaccaggggagctgttctcatgtaccaagggaagagattggaaccaagttgggccagtgtcaaaaaagacttgatctcatatggaggaggctggaggtttcaaggatcctggaacacgggagaagaagtgcaggtgattgctgttgaaccggggaagaacccaaaaaatgtacagacagcgccgggtaccttcaagacctctgaaggcgaagttggagccatagctctagactttaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttttagctcccacaagggttgtcgcctctgaaatggcagaggcgctcaagggaatgccaataaggtaccagacaacagcagtgaagagtgaacacacgggaagggagatagttgaccttatgtgtcacgccactttcactatgcgtctcctgtctcctgtgagagttcccaattacaacatgataatcatggatgaagcacatttcaccgatccagccagcatagcagccagagggtacatctcaacccgagtgggtatgggtgaagcagctgcgattttcatgacagccactccccccggatcggtggaggcctttccacagagcaatgcagttatccaagatgaggagaaagacattcctgaaagatcatggaactcaggctatgactggatcactgatttcccaggtaaaacagtctggttcgttccaagcatcaaatcaggaaatgacattgccaactgtttaagaaaaaatgggaaacgggtgatccaattgagcagaaaaacttttgacactgagtaccagaaaacgaaaaataacgactgggactatgttgtcacaacagacatttccgaaatgggagcaaactttcgagccgacagggtaatagacccaaggcgatgcctgaaaccggtaatactgaaagatggtccagagcgtgtcattctagccggaccgatgccagtgaccgtggctagtgccgcccagaggagaggaagaattggaaggaatcaaaataaggaaggtgatcagtatatttacatgggacagcctttaaataacgatgaggaccacgcccattggacagaagcaaaaatgctccttgacaacataaacacaccagaagggatcatcccagccctctttgagccagaaagagaaaagagtgctgcaatagacggggaatacagactacggggtgaagcgaggaaaacgtttgtggagctcatgagaagaggagatctacctgtctggctatcttacaaagttgcctcagaaggcttccaatactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttcctcaacatctaactcaaagggcccagaatgctttggacaatttggttatgctgcacaactctgaacaaggaggaaaagcttatagacacgccatggaagaattgccagacactatagagacgttgatgctcctagctctgatagctgtgctgactggtggagtgacgctgttcttcctatcaggaagaggcttagggaaaacatccattggcctactctgcgtgatgtcctcaagtgcactgttatggatggccagtgtggagccccattggatagcggcctctatcatactggagttctttctgatggtgttgcttattccggagccagacagacagcgcactccacaagacaaccagttagcatatgtggtgataggtttgttattcatgatattgacagtggcagccaatgagatgggattattagaaaccacaaagaaagacctggggattggtcatgcagctgctgaaaaccaccaccacgccgcaatgctggacgtagacctacatccagcttcagcctggactctctacgcagtggccacaacgattatcactcccatgatgagacacacaattgaaaacacaacggcaaacatttccctgacagccattgcaaaccaggcagctatattgatgggacttgataagggatggccaatatcaaagatggacataggagttccacttctcgccttggggtgctattctcaggtgaacccgctgacgctgacagcggcggtactgatgctagtggctcattatgccataattggaccaggactgcaagcaaaagccactagagaagctcaaaaaagaacagcagccggaataatgaaaaacccaactgtcgacgggatcgttgcaatagatttagaccctgtggtttatgatgcaaaatttgaaaaacagctaggccaaataatgttgttgatactatgcacatctcagattctcttgatgcggaccacatgggccttgtgtgaatccatcacactggccacaggacctctgaccacgctttgggagggatctccaggaaaattctggaacaccacgatagcggtgtccatggcaaacatttttagggggagttatctagcaggagcgggtctggccttttcattaatgaaatctctaggaggaagtaggagagggacgggagcccaaggagaaacactgggagaaaagtggaaaagacagctaaaccaattgagcaagtcagaatttaacatttacaagaggagtggtattgtagaggtggatagatctgaagccaaggaggggttaaaaagaggagaaacaatcaaacacgcagtgtcgagaggaacggccaaactgaggtggtttgtggagaggaaccttgtgaaaccagaagggaaagtcatagacctcggctgtggaagaggtggctggtcatattactgcgctgggctgaagaaagtcacagaagtgaaaggatacacaaaaggaggacctggacatgaggaaccaatcccaatggcaacctatggatggaacctagtaaagctatactccgggaaagatgtattctttataccanctgagaaatgtgacacccttttgtgtgatattggtgagtcctctccgaacccgactatagaagaaggaagaacgttgcgtgttctaaagatggtagaaccatggctcagaggaaaccaattttgcataaagattctaaatccctacatgccgagtgtggtagaaactctggagcaaatgcaaagaaaacatggaggaatgctagtgcgaaatccactctcaagaaactccactcatgaaatgtactgggtttcatgtggaacaggaaacattgtgtcagcagtaaatatgacatctagaatgctgctgaatcgattcacgatggctcacaggaagccaacatatgaaagagatgtggacttgggcgctggaacgagacatgtggcagtagaaccagaggtggccaacctagacatcattggccagaggatagagaatataaaaaatgaacacaaatcaacatggcattatgatgaggacaacccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgataccacaccctttggacaacaaagggtgtttaaagagaaagttgacacgcgtacaccaaaagcgaaacgaggcacagcacaaattatggaggtgacagccaagtggttatggggttttctctccagaaacaaaaaacccagaatctgcacaagagaggagttcacaagaaaagtcaggtcaaatgcagctattggagcggtgttcgttgatgaaaatcaatggaactcagcaaaagaggcagtggaagatgaaaggttctgggatcttgtgcgcagagagagggagcttcataaacaaggaaaatgtgccacgtgtgtctacaacatgatgggaaagagagagaaaaaattaggagagttcggaaaggccaaaggaagtcgcgcaatatggtatatgtggttgggagcgcgcttcttagagtttgaagccctcggcttcatgaatgaagatcactggttcagcagagagaattcactcagtggagtggaaggagaaggactccacaaacttggatacatactcagagacatatcaaagattccagggggaaacatgtatgcagatgatacagccggatgggacacaagaataacagaggatgatcttcagaatgaggccaaaatcactgacatcatggaacctgaacacgccctactggccacgtcaatctttaagttaacctaccaaaacaaggttgtaagagtgcagagaccagcaaaaaatggaaccgtgatggatgtcatatccaggcgtgaccagagaggaagtggacaggttggaacttatggcttaaacaccttcaccaacatgggggcccaactaataagacaaatggagtctgagggaatcttttcacccagtgaattggaaaccccaaatttagctggaagagtccttgactggttggaaaaacatggcatcgagaggctgagaagaatggcaatcagtggagatgactgcgtggtgaaaccaattgatgacagatttgcaacagccttaacagccttgaatgacatgggaaaggtaagaaaagacataccgcaatgggaaccttcaaaaggatggaatgattggcaacaagtgcctttctgctcacaccacttccaccagctgattatgaaggatggaagggaaatagtagtgccatgccgcaaccaagatgaactggtaggtagggccagagtatcacaaggtgccggatggagcttgagagaaactgcatgtctaggcaagtcgtatgcacaaatgtggcagctgatgtacttccacaggagagacttgagattagcggctaatgctatttgttcagccgttccagttgattgggtcccaaccagtcgcaccacctggtcgatccatgcccaccatcaatggatgacaacagaagacatgttgtcagtgtggaatagggtttggatagaggaaaacccatggatggaggataaaactcacgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattacctagactacatgacatcaatgaagagattcaaaaacgagagtgatcccgaaggggcactctggtaa

SEQ ID NO: 72 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaactggtgatggcctttatagcattcctaagatttctagccatacctccaacagcaggaattttggctagatggggctcattcaagaagaatggagcgattaaagtattgcggggtttcaaaaaagaaatctcaaacatgttgaacataatgaacaggaggaaaagatctgtgaccatgctcctcatgctattgcccacagccctgacgttccatctgaccacccgagggggagagccgcacatgatagttggcaagcaggaaagaggaaagtcacttttgtttaagacctctgcaggtgtcaacatgtgtacccttattgcaatggatctgggagagttatgtgatgacacgatgacctacaaatgcccccggatcactgagacggaaccagatgacgttgactgttggtgcaatgccacggagacatgggtgacctatggaacatgttctcaaaccggtgaacaccgacgagacaaacgttccgttgcactggcaccacacgtagggcttggtctggaaacaagaaccgaaacgtggatgtcctctgaaggcgcttggagacaaatacaaaaagtggagacatgggccctgagacacccaggattcacggtgatagccctttttctagcacatgccatagggacatctatcacccagaaagggattattttcattttgctgatgctggtaactccatccatggccatgcggtgcgtgggaataggaaacagagacttcgtggaaggactgtcaggagctacgtgggtggatgtagtactggagcatggaagttgtgtcactaccatggcaaaagacaaaccaacactggacattgaactcttgaagacggaggtcacaaaccctgccgtcttgcgcaaactgtgcattgaagccaaaatatcaaataccaccactgattcgagatgtccgacacaaggagaagccacgttggtggaagaacaagacacgaactttgtgtgtcgacgaacgttcgtggacagaggctggggcaatggttgtggactattcggaaaaggtagcttaataacgtgtgctaagtttaagtgtgtgacaaaattggaaggaaagatagtccaatatgaaaacttaaaatactcagtgatcgttaccgtccacactggagaccagcaccaagttggaaatgagaccacagaacatggaacaattgcaaccataacacctcaagctcccacgtcggaaatacaactgacagactacggagctctgacactggactgttcacctagaacagggctagactttaatgagatggtgttgttgacaatgaaagaaaaatcatggctcgtccacaaacaatggtttctagacttaccactgccttggacttcaggggcttcaacatcccaagagatttggaatagacaagacttgctggtcacatttaagacagctcatgcaaagaagcaggaagtagtcgtactaggatcacaagaaggagcaatgcatactgcgttgactggagctacagaaatccaaacgtctggaacgacaacaatttttgcaggccatctgaaatgcagactaaaaatggacaaactgactctaaaaggaatatcatatgtaatgtgcacaggctcattcaagttagagaaggaagtggctgagacccagcatggaactgttctagtacaggttaaatacgaaggaacagatgcaccatgcaagatccccttctcgtcccaagatgagaagggagtaacccagaatgggagattggtaacggccaaccccatagtcactgacaaagaaaaaccagtcaatattgaggcggagccaccttttggtgagagttacatcgtggtaggagcaggagaaaaagctttgaaactaagctggttcaagaagggaagcagcatagggaaaatgtttgaagcaactgcccgtggagcacgaaggatggccatcttgggagacaccgcatgggacttcggttctataggaggagtgttcacgtctgtgggaaaactggtacaccagatttttggaactgcgtatggagtcttgttcagtggtgtctcttggactatgaaaataggaatagggattctgctgacatggctgggattaaactcaaggagcacgtctctttcaatgacgtgtatcgcagttggcatgatcacactgtacctaggagtcatggtccaggcggactcgggatgtgtaatcaactggaaaggcagagaactcaaatgtggaagtggcatttttgtcaccaatgaagttcacacctggacagagcaatacaaatttcaggccgactccccaaagagactatcagcagccattgggaaggcatgggaggaaggtgtgtgtggaattcgatcagccacccgtctcgagaacatcatgtggaagcaaatatcaaatgaattaaaccacatcttacttgaaaatgacatgaaatttacagtggtcgtaggagacgttagtggaatcttggcccaaggaaagaaatcgattaggccacaacccatggaacataaatactcgtggaaaagctggggaaaagccaaaatcattggagcagatgttcagaacactactttcatcatcgacggcccaaacaccccagaatgccctgatgaccaaagagcatggaacatctgggaagttgaagactatggatttggaattttcacgacaaacatatggttgaaattgcgtgactcctacacccaagtgtgtgaccatcgactaatgtcagctgccatcaaggatagcaaagcagtccatgctgacatggggtactggatagaaagtgaaaagaacgagacttggaagttggcaagagcctccttcatagaagtcaagacatgcatctggccaaagtctcacactctatggagcaatggagtcctggaaagtgagatgataatcccaaagatatatggaggaccaatatctcagcataattacagaccaggatatttcacacaaacagcaggaccgtggcacttaggcaagttggaactagattttgatttgtgtgaaggtaccacagttgttgtagatgaacactgtggaaatagaggaccatctcttagaaccacaacagtcacaggaaagataatccatgaatggtgctgtagatcttgcacgttaccccccctacgtttcaaaggagaagacgggtgctggtatggcatggaaatcagaccagtcaaggagaaggaagagaacctagtcaagtcaatggtctctgcagggtcaggagaggtggacagtttttcactaggactgttgtgcatatcaataatgatcgaagaggtaatgagatccagatggagcaggaaaatgctgatgactggaacattggctgtgttcctccttctcacaatgggacaattgacatggaacgatctaatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagaggagctaggggatggacttgcaatgggcatcatgatattaaaattactaactgattttcaatcacatcagctatgggccaccttgctgtctctgacatttgtcaaaacaaccttttcattgcactacgcatggaagacaatggctatgatactgtcaattgtatctctcttccctttatgcctgtccacgacttcccaaaaaacaacatggcttccggtgcttctggggtctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcgtgttatgtcatatccggaagctcggccgatttatcactggagaaagcggctgaggtttcctgggaagaagaagcagaacactctggtgcctcacacaacatactagtggagatccaagatgatggaaccatgaagataaaagatgaagagagagatgacacgatcaccatcctcctcaaagcaaccttgctagcaatctcaggggtatacccaatgtcaataccggcgactctctttgtgtggtatttttggcagaaaaagaaacagagatcaggagtgctatgggacacaccaagccctccagaagtggaaagagcagtccttgatgatggcatttatagaattctccaaaggggattgttgggcaggtctcaagtaggagtaggagttttccaagaaggcgtattccacacaatgtggcatgtcaccaggggagctgttctcatgtaccaagggaagagattggaaccaagttgggccagtgtcaaaaaagacttgatctcatatggaggaggctggaggtttcaaggatcctggaacacgggagaagaagtgcaggtgattgctgttgaaccggggaagaacccaaaaaatgtacagacagcgccgggtaccttcaagacctctgaaggcgaagttggagccatagctctagactttaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttctagctcccacaagggttgtcgcctctgaaatggcagaggcgctcaagggaatgccaataaggtatcagacaacagcagtgaagagtgaacacacgggaagggagatagttgaccttatgtgtcacgccactttcactatgcgtctcctgtctcctgtgagagttcccaattacaacatgataatcatggatgaagcacatttcaccgatccagccagcatagcagccagagggtacatctcaacccgagtgggtatgggtgaagcagctgcgattttcatgacagccactccccccggatcggtggaggcctttccacagagcaatgcagttatccaagatgaggagaaagacattcctgaaagatcatggaactcaggctatgactggatcactggtttcccaggtaaaacagtctggttcgttccaagcatcaaatcaggaaatgacattgccaactgtttaagaaaaaatgggaaacgggtgatccaattgagcagaaaaacttttgacactgagtaccagaaaacgaaaaataacgactgggactatgttgtcacaacagacatttccgaaatgggagcaaactttcgagccgacagggtaatagacccaaggcgatgcctgaaaccggtaatactgaaagatggtccagagcgtgtcattctagccggaccgatgccagtgaccgtggctagtgccgcccagaggagaggaagaattggaaggaaccaaaataaggaaggtgatcagtatatttacatgggacagcctttaaataacgatgaggaccacgcccattggacagaagcaaaaatgctccttgacaacataaacacaccagaagggatcatcccagccctctttgagccagaaagagaaaagagtgctgcaatagacggggaatacagactacggggtgaagcgaggaaaacgtttgtggagctcatgagaagaggagatctacctgtctggctatcttacaaagttgcctcagaaggcttccaatactccgacagaaggtggtgctttgatggggaaagaaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttcctcaacatctaactcaaagggcccagaatgctttggacaatttggttatgctgcacaactctgaacaaggaggaaaagcttacagacacgccatggaagaattgccagacactatagagacgttgatgctcctagctctgatagctgtgctgactggtggagtgacgctgttcttcctatcaggaagaggcttagggaaaacatccattggcctactctgcgtgatgtcctcaagtgcactgttatggatggccagtgtggagccccattggatagcggcctctatcatactggagttctttctgatggtgttgcttattccggagccagacagacagcgcactccacaagacaaccagttagcatatgtggtgataggtttgttattcatgatattgacagtggcagccaatgagatgggattattagaaaccacaaagaaagacctggggattggtcatgcagctgctgaaaaccaccaccacgccgcaatgctggacgtagacctacatccagcttcagcctggactctctacgcagtggccacaacgattatcactcccatgatgagacacacaattgaaaacacaacggcaaacatttccctgacagccattgcaaaccaggcagctatattgatgggacttgataagggatggccaatatcaaagatggacataggagttccacttctcgccttggggtgctattctcaggtgaacccgctgacgctgacagcggcggtactgatgctagtggctcattatgccataattggaccaggactgcaagcaaaagccactagagaagctcaaaaaagaacagcagccggaataatgaaaaacccaactgtcgacgggatcgttgcaatagatttagaccctgtggtttatgatgcaaaatttgaaaaacagctaggccaaataatgttgttgatactatgcacatctcagattctcttgatgcggaccacatgggccttgtgtgaatccatcacactggccacaggacctctgaccacgctttgggagggatctccaggaaaattctggaacaccacgatagcggtgtccatggcaaacatttttagggggagttatctagcaggagcgggtctggccttttcattaatgaaatctctaggaggaggtaggagagggacgggagcccaaggagaaacactgggagaaaagtggaaaagacagctaaaccaattgagcaagtcagaatttaacatttacaagaggagtggtattgtagaggtggatagatctgaagccaaggaggggttaaaaagaggagaaacaatcaaacacgcagtgtcgagaggaacggccaaactgaggtggtttgtggagaggaaccttgtgaaaccagaagggaaagtcatagacctcggctgtggaagaggtggctggtcatattactgcgctgggctgaagaaagtcacagaagtgaaaggatacacaaaaggaggacctggacatgaggaaccaatcccaatggcaacctatggatggaacctagtaaagctatactccgggaaagatgtattctttataccacctgagaaatgtgacacccttttgtgtgatattggtgagtcctctccgaacccgactatagaagaaggaagaacgttgcgtgttctaaagatggtagaaccatggctcagaggaaaccaattttgcataaagattctaaatccctacatgccgagtgtggtagaaactctggagcaaatgcaaagaaaacatggaggaatgctagtgcgaaatccactctcaagaaactccactcatgaaatgtactgggtttcatgtggaacaggaaacattgtgtcagcagtaaatatgacatctagaatgctgctgaatcgattcacgatggctcacaggaagccaacatatgaaagagatgtggacttgggcgctggaacgagacatgtggcagtagaaccagaggtggccaacctagacatcattggccagaggatagagaatataaaaaatgaacacaaatcaacatggcattatgatgaggacaacccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgataccacaccctttggacaacaaagggtgtttaaagagaaagttgacacgcgtacaccaaaagcgaaacgaggcacagcacaaattatggaggtgacagccaagtggttatggggttttctctccagaaacaaaaaacccagaatctgcacaagagaggagttcacaagaaaagtcaggtcaaatgcagctattggagcggtgttcgttgatgaaaatcaatggaactcagcaaaagaggcagtggaagatgaaaggttctgggatcttgtgcgcagagagagggagcttcataaacaaggaaaatgtgccacgtgtgtctacaacatgatgggaaagagagagaaaaaattaggagagttcggaaaggccaaaggaagtcgcgcaatatggtatatgtggttgggagcgcgcttcttagagtttgaagccctcggcttcatgaatgaagatcactggttcagcagagagaattcactcagtggagtggaaggagaaggactccacaaacttggatacatactcagagacatatcaaagattccagggggaaacatgtatgcagatgatacagccggatgggacacaagaataacagaggatgatcttcagaatgaggccaaaatcactgacatcatggaacctgaacacgccctactggccacgtcaatctttaagttaacctaccaaaacaaggttgtaagagtgcagagaccagcaaaaaatggaaccgtgatggatgtcatatccaggcgtgaccagagaggaagtggacaggttggaacttatggcttaaacaccttcaccaacatgggggcccaactaataagacaaatggagtctgagggaatcttttcacccagtgaattggaaaccccaaatttagctggaagagtccttgactggttggaaaaacatggcatcgagaggctgagaagaatggcaatcagtggagatgactgcgtggtgaaaccaattgatgacagatttgcaacagccttaacagccttgaatgacatgggaaaggtaagaaaagacataccgcaatgggaaccttcaaaaggatggaatgattggcaacaagtgcctttctgctcacaccacttccaccagctgattatgaaggatggaagggaaatagtagtgccgtgccgcaaccaagatgaactggtaggtagggccagagtatcacaaggtgccggatggagcttgagagaaactgcatgtctaggcaagtcgtatgcacaaatgtggcagctgatgtacttccacaggagagacttgagattagcggctaatgctatttgttcagccgttccagttgattgggtcccaaccagtcgcaccacctggtcgatccatgcccaccatcaatggatgacaacagaagacatgttgtcagtgtggaatagggtttggatagaggaaaacccatggatggaggataaaactcacgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattacctagactacatgacatcaatgaagagattcaaaaacgagagtgatcccgaaggggcactctggtaa

SEQ ID NO: 73 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaactggtgatggcttttatagcattcctaagatttctagccatacctccaacagcaggaattttggctagatggggctcattcaagaagaatggagcgattaaagtgttgcggggtttcaaaaaagaaatctcaaacatgttgaacataatgaacaggaggaaaagatctgtgaccatgctcctcatgctactgcccacagccctgacgttccatctgaccacccgagggggagagccgcacatgatagttggcaagcaggaaagaggaaagtcacttttgtttaagacctctgcaggtgtcaacatgtgtacccttattgcaatggatctgggagagttatgtgatgacacgatgacctacaaatgcccccggatcactgagacggaaccagatgacgttgactgttggtgcaatgccacggagacatgggtgacctatggaacatgttctcaaaccggtgaacaccgacgagacaaacgttccgttgcactggcaccacacgtagggcttggtctggaaacaagaaccgaaacgtggatgtcctctgaaggcgcttggagacaaatacaaaaagtggagacatgggccctgagacacccaggattcacggtgatagccctttttctagcacatgccatagggacatccatcacccagaaagggattattttcattttgctgatgctggtaactccatccatggccatgcggtgcgtgggaataggaaacagagacttcgtggaaggactgtcaggagctacgtgggtggatgtagtactggagcatggaagttgtgtcactaccatggcaaaagacaaaccaacactggacattgaactcttgaagacggaggtcacaaaccctgccgtcttgcgcaaactgtgcattgaagccaaaatatcaaataccaccactgattcgagatgtccgacacaaggagaagccacgttggtggaagaacaagacacgaactttgtgtgtcgacgaacgttcgtggacagaggctggggcaatggttgtggactattcggaaaaggtagcttaataacgtgtgctaagtttaagtgtgtgacaaaattggaaggaaagatagtccaatatgaaaacttaaaatactcagtgatcgttaccgtccacactggagaccagcaccaagttggaaatgagaccacagaacatggaacaattgcaaccataacacctcaagctcccacgtcggaaatacaactgacagactacggagctctgacactggactgttcacctagaacagggctagactttaatgagatggtgttgttgacaatgaaagaaaaatcatggctcgtccacaaacaatggtttctagacttaccactgccttggacttcaggggcttcaacatcccaagagacttggaatagacaagacttgctggtcacatttaagacagctcatgcaaagaagcaggaagtagtcgtactaggatcacaagaaggagcaatgcatactgcgttgactggagctacagaaatccaaacgtctggaacgacaacaatttttgcaggccatctgaaatgcagactaaaaatggacaaactgactctaaaaggaatatcatatgtaatgtgcacaggctcattcaagttagagaaggaagtggctgagacccagcatggaactgttctagtacaggttaaatacgaaggaacagatgcaccatgcaagatccccttctcgtctcaagatgagaagggagtaacccagaatgggagattggtaacggccaaccccatagtcactgacaaagaaaaaccagtcaatattgaggcggagccaccttttggtgagagttacatcgtggtaggagcaggagaaaaagctttgaaactaagctggttcaagaagggaagcagcatagggaaaatgtttgaagcaactgcccgtggagcacgaaggatggccatcttgggagacaccgcatgggacttcggttctataggaggagtgttcacgtctgtgggaaaactggtacaccagatttttggaactgcgtatggagtcttgttcagtggtgtctcttggaccatgaaaataggaatagggattctgctgacatggctgggattaaactcaaggagcacgtctctttcaatgacgtgtatcgcagttgggctgatcacactgtacctaggagtcatggtccaggcggactcgggatgtgtaatcaactggaaaggcagagaactcaaatgtggaagcggcatttttgtcaccaatgaagttcacacctggacagagcaatacaaatttcaggccgactccccaaagagactatcagcagccattgggaaggcatgggaggaaggtgtgtgtggaattcgatcagccacccgtctcgagaacatcatgtggaagcaaatatcaaatgaattaaaccacatcttacttgaaaatgacatgaaatttacagtggtcgtaggagacgttagtggaatcttggcccaaggaaagaaatcgattaggccacaacccatggaacataaatactcgtggaaaagctggggaaaagccaaaatcattggagcagatgttcagaacactactttcatcatcgacggcccaaacaccccagaatgccctgatgaccaaagagcatggaacatctgggaagttgaagactatggatttggaattttcacgacaaacatatggttgaaattgcgtgactcctacacccaagtgtgtgaccatcgactaatgtcagctgccatcaaggatagcaaagcagtccatgctgacatggggtactggatagaaagtgaaaagaacgagacttggaagttggcaagagcctccttcatagaagtcaagacatgcatctggccaaagtctcacactctatggagcaatggagtcctggaaagtgagatgataatcccaaagatatatggaggaccaatatctcagcataattacagaccaggatatttcacacaaacagcaggaccgtggcacttaggcaagttggaactagattttgatttgtgtgaaggtaccacagttgttgtagatgaacactgtggaaatagaggaccatctcttagaaccacaacagtcacaggaaagataatccatgaatggtgctgtagatcttgcacgttaccccccctacgtttcaaaggagaagacgggtgctggtatggcatggaaatcagaccagtcaaggagaaggaagagaacctagtcaagtcaatggtctctgcagggtcaggagaggtggacagtttttcactaggactgttgtgcatatcaataatgatcgaagaggtaatgagatccagatggagcaggaaaatgctgatgactggaacattggctgtgttcctccttctcacaatgggacaattgacatggaacgatctaatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagaggagctaggggatggacttgcaatgggcatcatgatattaaaattactaactgattttcaatcacatcagctatgggccaccttgctgtctctgacatttgtcaaaacaaccttttcattgcactacgcatggaagacaatggctatgatactgtcaattgtatctctcttccctttatgcctgtccacgacttctcaaaaaacaacatggcttccggtgcttctggggtctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcgtgttatgtcatatccggaagctcggccgatttatcactggagaaagcggctgaggtctcctgggaagaagaagcagaacactctggtgcctcacacaacatactagtggagatccaagatgatggaaccatgaagataaaagatgaagagagagatgacacgatcaccatcctcctcaaagcaaccttgctagcaatctcaggggtatacccaatgtcaataccggcgactctctttgtgtggtatttttggcagaaaaagaaacagagatcaggagtgctatgggacacaccaagccctccagaagtggaaagagcagtccttgatgatggcatttatagaattctccaaaggggattgttgggcaggtctcaagtaggagtaggagttttccaagaaggcgtattccacacaatgtggcatgtcaccaggggagctgttctcatgtaccaagggaagagattggaaccaagttgggccagtgtcaaaaaagacttgatctcatatggaggaggctggaggtttcaaggatcctggaacacgggagaagaagtgcaggtgattgctgttgaaccggggaagaacccaaaaaatgtacagacagcgccgggtaccttcaagacctctgaaggcgaagttggagccatagctctagactttaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttttagctcccacaagggttgtcgcctctgaaatggcagaggcgctcaagggaatgccaataaggtatcagacaacagcagtgaagagtgaacacacgggaagggagatagttgaccttatgtgtcacgccactttcactatgcgtctcctgtctcctgtgagagttcccaattacaacatgataatcatggatgaagcacatttcaccgatccagccagcatagcagccagagggtacatctcaacccgagtgggtatgggtgaagcagctgcgattttcatgacagccactccccccggatcggtggaggcctttccacagagcaatgcagttatccaagatgaggagaaagacattcctgaaagatcatggaactcaggctatgactggatcactgatttcccaggtaaaacagtctggttcgttccaagcatcaaatcaggaaatgacattgccaactgtttaagaaaaaatgggaaacgggtgatccaattgagcagaaaaacttttgacactgagtaccagaaaacgaaaaataacgactgggactatgttgtcacaacagacatttccgaaatgggagcaaactttcgagccgacagggtaatagacccaaggcgatgcctgaaaccggtaatactgaaagatggtccagagcgtgtcattctagccggaccgatgccagtgaccgtggctagtgccgcccagaggagaggaagaattggaaggaaccaaaataaggaaggtgatcagtatatttacatgggacagcctttaaataacgatgaggaccacgcccattggacagaagcaaaaatgctccttgacaacataaacacaccagaagggatcatcccagccctctttgagccagaaagagaaaagagtgctgcaatagacggggaatacagactacggggtgaagcgaggaaaacgtttgtggagctcatgagaagaggagatctacctgtctggctatcttacaaagttgcctcagaaggcttccaatactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttcctcaacatctaactcaaagggcccagaatgctttggacaatttggttatgctgcacaactctgaacaaggaggaaaagcttatagacacgccatggaagaattgccagacactatagagacgttgatgctcctagctctgatagctgtgctgactggtggagtgacgctgttcttcctatcaggaagaggcttagggaaaacatccattggcctactctgcgtgatgtcctcaagtgcactgttatggatggccagtgtggagccccattggatagcggcctctatcatactggagttctttctgatggtgttgcttattccggagccagacagacagcgcactccacaagacaaccagttagcatatgtggtgataggtttgttattcatgatattgacagtggcagccaatgagatgggattattagaaaccacaaagaaagacctggggattggtcatgcagctgctgaaaaccaccaccacgccgcaatgctggacgtagacctacatccagcttcagcctggactctctacgcagtggccacaacgattatcactcccatgatgagacacacaattgaaaacacaacggcaaacatttccctgacagccattgcaaaccaggcagctatattgatgggacttgataagggatggccaatatcaaagatggacataggagttccacttctcgccttggggtgctattctcaggtgaacccgctgacgctgacagcggcggtactgatgctagtggctcattatgccataattggaccaggactgcaagcaaaagccactagagaagctcaaaaaagaacagcagccggaataatgaaaaacccaactgtcgacgggatcgttgcaatagatttagaccctgtggtttatgatgcaaaatttgaaaaacagctaggccaaataatgttgttgatactatgcacatctcagattctcttgatgcggaccacatgggccttgtgtgaatccatcacactggccacaggacctctgaccacgctttgggagggatctccaggaaaattctggaacaccacgatagcggtgtccatggcaaacatttttagggggagttatctagcaggagcgggtctggccttttcattaatgaaatctctaggaggaggtaggagagggacgggagcccaaggagaaacactgggagaaaagtggaaaagacagctaaaccaattgagcaagtcagaatttaacatttacaagaggagtggtattgtagaggtggatagatctgaagccaaggaggggttaaaaagaggagaaacaatcaaacacgcagtgtcgagaggaacggccaaactgaggtggtttgtggagaggaaccttgtgaaaccagaagggaaagtcatagacctcggctgtggaagaggtggctggtcatattactgcgctgggctgaagaaagtcacagaagtgaaaggatacacaaaaggaggacctggacatgaggaaccaatcccaatggcaacctatggatggaacctagtaaagctatactccgggaaagatgtattctttataccacctgagaaatgtgacacccttttgtgtgatattggtgagtcctctccgaacccgactatagaagaaggaagaacgttgcgtgttctaaagatggtagaaccatggctcagaggaaaccaattttgcataaagattctaaatccctacatgccgagtgtggtagaaactctggagcaaatgcaaagaaaacatggaggaatgctagtgcgaaatccactctcaagaaactccactcatgaaatgtactgggtttcatgtggaacaggaaacattgtgtcagcagtaaatatgacatctagaatgctgctgaatcgattcacgatggctcacaggaagccaacatatgaaagagatgtggacttgggcgctggaacgagacatgtggcagtagaaccagaggtggccaacctagacatcattggccagaggatagagaatataaaaaatgaacacaaatcaacatggcattatgatgaggacaacccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgataccacaccctttggacaacaaagggtgtttaaagagaaagttgacacgcgtacaccaaaagcgaaacgaggcacagcacaaattatggaggtgacagccaagtggttatggggttttctctccagaaacaaaaaacccagaatctgcacaagagaggagttcacaagaaaagtcaggtcaaatgcagctattggagcggtgttcgttgatgaaaatcaatggaactcagcaaaagaggcagtggaagatgaaaggttctgggatcttgtgcgcagagagagggagcttcataaacaaggaaaatgtgccacgtgtgtctacaacatgatgggaaagagagagaaaaaattaggagagttcggaaaggccaaaggaagtcgcgcaatatggtatatgtggttgggagcgcgcttcttagagtttgaagccctcggcttcatgaatgaagatcactggttcagcagagagaattcactcagtggagtggaaggagaaggactccacaaacttggatacatactcagagacatatcaaagattccagggggaaacatgtatgcagatgatacagccggatgggacacaagaataacagaggatgatcttcagaatgaggccaaaatcactgacatcatggaacctgaacacgccctactggccacgtcaatctttaagttaacctaccaaaacaaggttgtaagagtgcagagaccagcaaaaaatggaaccgtgatggatgtcatatccaggcgtgaccagagaggaagtggacaggttggaacttatggcttaaacaccttcaccaacatgggggcccaactaataagacaaatggagtctgagggaatcttttcacccagtgaattggaaaccccaaatttagctggaagagtccttgactggttggaaaaacatggcatcgagaggctgagaagaatggcaatcagtggagatgactgcgtggtgaaaccaattgatgacagatttgcaacagccttaacagccttgaatgatatgggaaaggtaagaaaagacataccgcaatgggaaccttcaaaaggatggaatgattggcaacaagtgcctttctgctcacaccacttccaccagctgattatgaaggatggaagggaaatagtagtgccatgccgcaaccaagatgaactggtaggtagggccagagtatcacaaggtgccggatggagcttgagagaaactgcatgtctaggcaagtcgtatgcacaaatgtggcagctgatgtacttccacaggagagacttgagattagcggctaatgctatttgttcagccgttccagttgattgggtcccaaccagtcgcaccacctggtcgatccatgcccaccatcaatggatgacaacagaagacatgttgtcagtgtggaatagggtttggatagaggaaaacccatggatggaggataaaactcacgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattacctagactacatgacatcaatgaagagattcaaaaacgagagtgatcccgaaggggcactctggtaa

SEQ ID NO: 74 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcattcctaagatttctagccatacctccaacagcaggaattttggctagatggagctcattcaagaagaatggagcgatcaaagtgttacggggtttcaaaaaagagatctcaagcatgttgaacataatgaacaggaggaaaagatccgtgactatgctcctcatgctgctgcccactgccctgacattccatttgaccacacgagggggagagccacacatgatagttagcaagcaggaaagaggaaagtcactcttgtttaagacctctgtaggtgtcaatatgtgcactctcattgcgatggatttgggagagttatgtgaggacacaatgacctacaaatgcccccggatcactgaggcggaaccagatgatgttgactgttggtgcaatgccacagacacatgggtgacctatgggacgtgttctcaaaccggcgaacaccgacgagacaaacgttccgtcgcactggccccacatgtgggacttggtctggaaacaagaaccgaaacgtggatgtcctctgaaggcgcctggaaacaaatacaaaaagtggagacttgggctttgcgacacccaggatttacggtgatagcccttttcttggcacatgccataggaacatccatcactcagaaagggatcattttcattctgctgatgctggtaacaccatcaatggccatgcgatgcgtgggaataggcaatagagactttgttgaaggactgtcaggagcaacgtgggtggatgtagtactggagcatggaagctgcgtcaccaccatggcaaaaaataaaccaacactggacattgaacttctgaaaacggaggtcacgaaccctgccgtcctgcgcaaactgtgcattgaagctaaaatatcaaacaccaccaccgattcaagatgtccaacacaaggagaagctacactggtggaagaacaagatgcgaactttgtgtgtcgacgaacgttcgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgatcgactacggagccctcacattggattgctcacctagaactgggctggactttaatgagatggtgctattgacaatgaaaggaaaatcatggcttgtccacaaacaatggtttctagacttaccactgccttggacttcgggggcttcaacatcccaagagacttggaacagacaggatttgctggtcacattcaagacagctcatgcaaagaagcaggaagttgtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtgatgtgcacaggctcatttaagctagagaaggaagtggctgagacccagcatggaactgtcttagtgcaggttaaatacgaaggaacagatgcaccatgcaagatccccttttcgacccaagatgagaaaggagtgacccagaatgggagattgataacagccaatcctatagttactgacaaagaaaaaccagttaacattgagacagaaccaccatttggtgagagctacatcgtggtaggggcaggtgaaaaagctttgaaactaagttggttcaagaaaggaagcagcatagggaaaatgttcgaagcaaccgcccgaggagcacgaaggatggctatcctgggagacaccgcatgggacttcggttccataggaggagtgttcacgtctgtgggaaaattgacacatcaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaaaactgtcagcagccattggaaaggcatgggaggagggcgtgtgtggaattcgatcagccacgcgtcttgagaacatcatgtggaagcaaatatcaaatgaattgaactacatcttacttgaaaatgacatgaaattcacagtggttgtaggagatgccaatggaattttggcccaagggaaaaaaatgattagaccacaacccatggaacacaaatattcatggaaaagctggggaaaagccaaaatcataggagcagacatacagaacaccactttcattattgacggcccagatactccagaatgtcccgatgaccagagagcatggaacatttgggaagttgaggactatggattcggaattttcacgacaaacatatggctgaaattgcgtgactcctatacccaaatgtgtgaccaccggctaatgtcagctgccatcaaggacagcaaggcagtccatgctgatatggggtactggatagaaagtgaaaagaacgagacctggaagctagcgagagcctcctttatagaagtcaagacatgcatctggccgaaatcccacactctatggagtaatggagtcttggaaagtgaaatgataattccaaagatatatggaggaccaatatctcagcacaactacagaccagggtatttcacacaaacagcagggccatggcacctaggcaagttggaattggattttgatttgtgtgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggtatggaaatcagaccagttaaggagaaggaggagaatctagttaggtcaatggtctctgcagggtcaggagaagtggacagtttttcattaggaatactatgcgtatcaatactaattgaagaagtgatgagatccaaatggagtagaaagatgctgatgactggaacactggctgttttcctccttcttataatgggacaactgacatggaatgatttgaccaggttatgcatcatggttggagccaatgcttcagacaggatggggatgggaacaacatacctagccttgatggctactttcaaaatgagaccaatgtttgctgttgggctattatttcgtagactaacatccagagaagttcttcttctcacgattggattaagcctggtggcatccgtggagctaccaaattctttagaggagctaggggatggactcgcaatgggcatcatgatattaaaattattgactgattttcagccacaccagttatggaccaccttactgtctttaacatttatcaaaacgactctttcattggattatgcatggaagacaatggccatgacactgtcaattgtatctctctttcctttgtgtctgtctacgacctcccaaaaaacaacatggcttccggtgctgttaggatcctttggatgtaaaccattaaccatgtttcttataacagaaaacaaaatctggggaaggaaaagttggcccatcaatgaaggaatcatggctgttggaatagtcagcattctactaagttcactcctcaaaaatgatgtgccgctagccggcccactaatagctggaggcatgttaatagcatgttatgtcatatccggaagctcagccgatctatcattggagaaagcggctgaggtgtcctgggaagaagaagcagaacactctggtacctcacacaacatattggtggaggttcaagatgatggaaccatgaaaataaaagatgaagagagggatgacacactcaccatactccttaaagcaactctgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatttatagaatcttgcagagaggactgttggggaggtcccaagtaggagtgggagttttccaagacggcgtgttccacacaatgtggcacgtcaccaggggagctgtccttatgtaccaagggaagaggctggaaccaagctgggctagtgtcaaaaaagacttgatctcatatggaggaggttggaggtttcaaggatcatggaacacaggagaagaagtgcaagtgatagctgttgaaccaggaaaaaaccccaaaaatgtacagacaacgccgggtaccttcaagactcctgaaggcgaagttggagccatagctctagacttcaaacccggcacatctggatctcccatcgtgaacagagagggaaaaatagtaggtctttatggaaatggagtggtgacaacaagtggaacctacgtcagtgccatcgctcaagccaaagcatcgcaagaagggcctctaccagagattgaggacgaggtgtttaagaaaagaaacttaacaataatggacctgcatccaggatcaggaaaaacaagaagatatcttccagccatagtccgtgaggccataaaaaggaagctgcgcacgctaatcttggctcccacaagagttgtcgcctctgaaatggcagaggcgctcaagggaatgccaataagatatcagacaacagcagtgaagagtgaacatacaggaagggagatagttgacctcatgtgccacgccacttttaccatgcgtctcttatctccagtgagagttcccaattacaacatgattatcatggatgaagcacattttaccgatccagccagcatagcggccagagggtacatctcaacccgagtgggtatgggtgaagcagctgcgatcttcatgacagccacacccccaggatcggtggaggcctttccacagagtaatgcagttatccaagacgaggaaaaagacattcctgagagatcatggaactcaggctacgactggatcactgattttccaggtaaaacagtttggtttgtcccaagcatcaaatcaggaaatgatattgccaactgtttaagaaagaacggaaaacgggtgattcaactgagcaggaaaacatttgacactgagtaccagaaaacaaaaaacaatgactgggactatgttgtcacaacagacatttccgaaatgggagcaaatttccgagccgatagggtgatagatccaaggcggtgcttgaaaccggtaatactaaaagatggtccagagcgcgtcattctagccggaccaatgccagtgactgtggccagtgctgcccagaggagaggaagaattggaaggaatcaaaacaaagaaggtgatcagtacgtttacatgggacagcctttaaataatgatgaggatcacgcccactggacagaagcaaaaatgctcctcgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcttacaaagtcgcctcagaaggtttccaatattccgacagaagatggtgttttgatggggaaaggaacaaccaggtgttggaggagaacatggacgtggagatctggacaaaggaaggagaaagaaagaaattgcgaccccgctggttggatgctagaacttactctgatccattggccctgcgcgagtttaaagagtttgcagcaggaagaagaagtgtctcaggtgacctaatattggaaataggaaaacttccacaacatttgacgctaagagcccagaatgctttggataatttggtcatgttgcacaattccgaacaaggaggaaaagcctacagacatgctatggaggaactaccagacaccatagaaacattgatgctcctagctttgatagctgtgctgactggtggagtgacgctgttcttcctatcaggaaaaggtctaggaaaaacatccattggcctactctgtgtgatggcctcaagcgcactgttatggatggccagtgtggagccccattggatagcggcctccatcatactagagttctttctgatggtgctgctcattccagagccagacagacagcgcaccccacaggacaaccagttagcatatgtggtgataggcttgttattcatgatactcacagtggcagccaacgagatgggattgttggaaaccacaaagaaagacctggggattggccacgtagccgccgaaaaccaccaccatgctacaatgttggacgtagacctacgtccagcttcagcctggaccctctatgcagtagccacaacagttatcacccccatgatgaggcacacaattgaaaatacaacggcaaatatttccctgacagccattgcaaatcaggcagccatattgatgggacttgacaagggatggccaatatcgaagatggacataggagttccacttcttgccttagggtgctattcccaggtgaacccattgacactgacagcagcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggtcaaataatgttactgatactttgtacatcacagattctcttgatgcggaccacatgggctttgtgtgaatccatcacactggctactggacccttgaccactctttgggagggatctccaggaaaattctggaacaccacgatagcagtgtccatggcaaacatcttcaggggaagttatctagcaggagcaggtctggccttctcattgatgaaatctttaggaggaggtaggagaggcacgggagctcaaggggaaacactgggagaaaaatggaaaagacagctaaaccaactgagcaagtcagaatttaacacctacaaaaggagtgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgcgctgggctgaagaaagtcactgaagtgaagggatatacaaaaggaggacctggacatgaggaacctatcccaatggcgacctatggatggaacctagtaaagctgcactctggaaaagatgtgttcttcataccgcctgagaaatgtgacacccttttgtgtgatatcggtgagtcctctccgaatccaactatagaagaaggaagaacgttacgtgttctaaagatggtggaaccatggctcaaaggaaaccaattctgcataaagatcctgaatccttacatgccaagtgtggtagaaactctggagcaaatgcaaagaaaacatggagggatgctggtgcgaaacccactctcaagaaattccacccatgaaatgtactgggtttcatgtggaacaggaaacattgtgtcggcagtgaacatgacatccagaatgttactgaaccgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcttatcatggatcgtatgaggtcaagccatcaggatcagcctcatccatggtgaatggcgtggtgagattgctcaccaaaccatgggatgttatccctatggtcacacaaatagccatgactgataccacaccattcggacaacagagggtgtttaaagagaaagttgacacgcgcacaccaagagcaaaacgaggcacagcacaaattatggaggtgacagccaagtggttatggggtttcctttccagaaacaaaaaacccagaatctgcacaagagaggagttcacaagaaaagtcaggtcaaacgcagcaataggagcagtgttcgttgatgaaaaccaatggaactcagcaaaagaagcagtggaagacgaaaggttttgggatctcgtacacagagagagggagcttcataaacagggaaaatgtgccacgtgtgtttacaacatgatggggaagagagagaaaaaattaggagagtttggaaaagcaaaaggaagccgtgcaatatggtacatgtggctgggagcacgctttctagaatttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacagcaatttttaaactgacctaccaaaataaggtggtgagggtgcaaagaccagcaaaaagtggaaccgtaatggatgtcatatccagacgtgaccagagaggaagtggacaggtcggaacttatggcttaaacactttcaccaatatggaggctcaattaataagacaaatggagtctgaaggaatcttcctacccagcgaattggaaacccccaatctagctaagagagttcttgactggttggaaaaatatggcgccgaaaggctgaaaagaatggcaattagcggagatgattgtgtggtgaaaccaattgatgacaggttcgcaaaggccttaacagctctgaatgatatgggaaaagtaagaaaagacataccgcagtgggaaccttcaaaaggatggaatgactggcagcaagtgcctttctgttcacaccacttccaccagctgatcatgaaagatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgactgggtcccaaccagccgcactacctggtcgatccatgcccaccaccaatggatgacaacagaagacatgttatcagtgtggaatagggtttggatagaggaaaacccatggatggaggacaaaactcatgtatccagttgggaagaggttccatacttagggaaaagggaagatcaatggtgtggatccctgataggcttgacagcgagggccacctgggccaccaacatacaagtagccataaaccaggtgagaaggctcatcgggaatgagaattatctagattacatggcatcgatgaagagattcaagaatgagagtgatcccgaaggggcgctctggtag

SEQ ID NO: 75 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggtcaaggacccatgaaactggtgatggcttttatagcattcctaagatttctagccatacctccaacagcaggaattttggctagatggggctcattcaagaagaatggagcgattaaagtgttacggggtttcaaaaaagaaatctcaaacatgttgaacataatgaacaggagaaaaagatctgtgaccatgctcctcatgctgctgcccacagtcttgacgttccatttgaccacccgagggggagagcctcacatgatagttagcaaacaggaaagaggaaagtcacttttgtttaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaagggattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaataccaccactgactcgagatgtccgacacaaggagaagccacgctggtggaagaacaagacacgaactttgtgtgtcgacgaacattcgtggacagaggctggggcaatggttgtggactattcggaaagggtagcttaataacgtgtgctaagtttaagtgtgtgacaaaattggaaggaaagatagtccaatatgaaaacttaaaatattctgtgatcgttaccgtccacactggagaccagcaccaagttggaaatgagaccacagaacatggaacaattgcaaccataacacctcaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggacctcaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagctggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcatggaacatctgggaagttgaagactatggatttggaattttcacgacaaacatatggttgaaattgcgtgattcctacacccaagtgtgtgaccatcgactaatgtcggctgccatcaaggatagcaaagcagtccatgctgacatggggtactggatagaaagtgaaaagaacgagacttggaagttggcaagagcctccttcatagaagtcaagacatgcgtctggccaaaatctcacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggaaatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagacgagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacagcgccaggtaccttcaagacttctgaaggcgaagttggagccatagctctagacttcaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcctttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaaggtggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattagaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctttgatagctgtgctgactggtggagtgacgctgttcttcctatcaggaagaggcttagggaaaacatccataggcctactctgcgtgacgtcctcaagtgcactgttatggatggccagtgtggagccccattggatagcggcctctattatactagagttctttctgatggtgttgcttattccagagccagatagacagcgcactccacaagacaaccagttagcatatgtggtgataggtttgctattcatgatattgacagtggcagccaatgagatgggattattggaaaccacaaagaaagacctggggattggtcatgcagctgctgaaaaccaccaccacgccgcaatgctggacgtagacctccatccagcttcagcctggaccctctacgcagtggccacaacgattatcactcccatgatgagacacacaattgaaaacacaacggcaaatatttccctgacagctattgcaaaccaggcagctatattgatgggacttgataagggatggccaatatcaaagatggacataggagttccacttctcgccttggggtgctattctcaagtgaacccgctgacgctgacagcagcggtactgatgctagtagcccattatgccataattggaccaggactgcaagcaaaagccactagagaagctcaaaaaaggacggcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagttgaaccaattgagcaagtcagaatttaacacttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaacctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgctacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacccagcgaattggaaaccccaaatttagccggaagagtccttgactggttggaaaaacatggcaccgagaggctgagaagaatggcaatcagtggagatgactgtgtggtgaaaccaattgatgacagatttgcaacagccttaacagccttgaatgacatgggaaaggtaagaaaagacataccgcaatgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacaggagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattatctagactacatgacatcaatgaagagattcaaaaacgagagtgatcccgaaggggcactctggtaa

SEQ ID NO: 76 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggtcaaggacccatgaaactggtgatggcttttatagcattcctaagatttctagccatacctccaacagcaggaattttggctagatggggctcattcaagaagaatggagcgattaaagtgttacggggtttcaaaaaagaaatctcaaacatgttgaacataatgaacaggagaaaaagatctgtgaccatgctcctcatgctgctgcccacagtcctgacgttccatttgaccacccgagggggagagcctcacatgatagttagcaaacaggaaagaggaaagtcacttttgtttaagacctctgcaggtgtcaacatgtgcacccttattgcaatggacctgggagagttatgtgatgacacgatgacctacaaatgtccccggatcactgagacagaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaagggattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaataccaccactgactcgagatgtccgacacaaggagaagccacgctggtggaagaacaagacacgaactttgtgtgtcgacgaacattcgtggacagaggctggggcaatggttgtggactattcggaaagggtagcttaataacgtgtgctaagtttaagtgtgtgacaaaattggaaggaaagatagtccaatatgaaaacttaaaatattctgtgatcgttaccgtccacactggagaccagcaccaagttggaaatgagaccacagaacatggaacaattgcaaccataacacctcaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggacctcaggggcctcaacgtcccaagagacttggaacagacaagacttgctggtcacgtttaagacagctcatgcaaagaagcaggaagcagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagctggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcatggaacatctgggaagttgaagactatggatttggaattttcacgacaaacatatggttgaaattgcgtgattcctacacccaagtgtgtgaccatcgactaatgtcggctgccatcaaggatagcaaagcagtccatgctgacatggggtactggatagaaagtgaaaagaacgagacttggaagttggcaagagcctccttcatagaagtcaagacatgcgtctggccaaaatctcacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggaaatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagacgagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagttttccaagaaggcgtattccacacaatgtggcacgtcaccaggggagctgttcttatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacagcgccaggtaccttcaagacttctgaaggcgaagttggagccatagctctagacttcaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcctttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaaggtggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattagaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctttgatagctgtgctgactggtggagtgacgctgttcttcctatcaggaagaggcttagggaaaacatccataggcctactctgcgtgacgtcctcaagtgcactgttatggatggccagtgtggagccccattggatagcggcctctattatactagagttctttctgatggtgttgcttattccagagccagatagacagcgcactccacaagacaaccagttagcatatgtggtgataggtttgctattcatgatattgacagtggcagccaatgagatgggattattggaaaccacaaagaaagacctggggattggtcatgcagctgctgaaaaccaccaccacgccgcaatgctggacgtagacctccatccagcttcagcctggaccctctacgcagtggccacaacgattatcactcccatgatgagacacacaattgaaaacacaacggcaaatatttccctgacagctattgcaaaccaggcagctatattgatgggacttgataagggatggccaatatcaaagatggacataggagttccacttctcgccttggggtgctattctcaagtgaacccgctgacgctgacagcagcggtactgatgctagtagcccattatgccataattggaccaggactgcaagcaaaagccactagagaagctcaaaaaaggacggcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcagaatttaacacttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaacctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctccagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgctacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacccagcgaattggaaaccccaaatttagccggaagagtccttgactggttggaaaaacatggcaccgagaggctgagaagaatggcaatcagtggagatgactgtgtggtgaaaccaattgatgacagatttgcaacagccttaacagccttgaatgacatgggaaaggtaagaaaagacataccgcaatgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacaggagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattatctagactacatgacatcaatgaagagattcaaaaacgagagtgatcccgaaggggcactctggtaa

SEQ ID NO: 77 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggtcaaggacccatgaaactggtgatggcttttatagcattcctaagatttctagccatacctccaacagcaggaattttggctagatggggctcattcaagaagaatggagcgattaaagtgttacggggtttcaaaaaagaaatctcaaacatgttgaacataatgaacaggagaaaaagatctgtgaccatgctcctcatgctgctgcccacagtcctgacgttccatttgaccacccgagggggagagcctcacatgatagttagcaaacaggaaagaggaaagtcacttttgtttaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaagggattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaataccaccactgactcgagatgtccgacacaaggagaagccacgctggtggaagaacaagacacgaactttgtgtgtcgacgaacattcgtggacagaggctggggcaatggttgtggactattcggaaagggtagcttaataacgtgtgctaagtttaagtgtgtgacaaaattggaaggaaagatagtccaatatgaaaacttaaaatattctgtgatcgttaccgtccacactggagaccagcaccaagttggaaatgagaccacagaacatggaacaattgcaaccataacacctcaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggacctcaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagctggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcatggaacatctgggaagttgaagactatggatttggaattttcacgacaaacatatggttgaaattgcgtgattcctacacccaagtgtgtgaccatcgactaatgtcggctgccatcaaggatagcaaagcagtccatgctgacatggggtactggatagaaagtgaaaagaacgagacttggaagttggcaagagcctccttcatagaagtcaagacatgcgtctggccaaaatctcacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggaaatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagacgagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacagcgccaggtaccttcaagacttctgaaggcgaagttggagccatagctctagacttcaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcctttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaaggtggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattagaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctttgatagctgtgctgactggtggagtgacgctgttcttcctatcaggaagaggcttagggaaaacatccataggcctactctgcgtgacgtcctcaagtgcactgttatggatggccagtgtggagccccattggatagcggcctctattatactagagttctttctgatggtgttgcttattccagagccagatagacagcgcactccacaagacaaccagttagcatatgtggtgataggtttgctattcatgatattgacagtggcagccaatgagatgggattattggaaaccacaaagaaagacctggggattggtcatgcagctgctgaaaaccaccaccacgccgcaatgctggacgtagacctccatccagcttcagcctggaccctctacgcagtggccacaacgattatcactcccatgatgagacacacaattgaaaacacaacggcaaatatttccctgacagctattgcaaaccaggcagctatattgatgggacttgataagggatggccaatatcaaagatggacataggagttccacttctcgccttggggtgctattctcaagtgaacccgctgacgctgacagcagcggtactgatgctagtagcccattatgccataattggaccaggactgcaagcaaaagccactagagaagctcaaaaaaggacggcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcagaatttaacacttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaacctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgctacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacccagcgaattggaaaccccaaatttagccggaagagtccttgactggttggaaaaacatggcaccgagaggctgagaagaatggcaatcagtggagatgactgtgtggtgaaaccaattgatgacagatttgcaacagccttaacagccttgaatgacatgggaaaggtaagaaaagacataccgcaatgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacaggagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattatctagactacatgacatcaatgaagagattcaaaaacgagagtgatcccgaaggggcactctggtaa

SEQ ID NO: 78 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggtcaaggacccatgaaactggtgatggcttttatagcattcctaagatttctagccatacctccaacagcaggaattttggctagatggggctcattcaagaagaatggagcgattaaagtgttacggggtttcaaaaaagaaatctcaaacatgttgaacataatgaacaggagaaaaagatctgtgaccatgctcctcatgctgctgcccacagtcctgacgttccatttgaccacccgagggggagagcctcacatgatagttagcaaacaggaaagaggaaagtcacttttgtttaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaagggattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaataccaccactgactcgagatgtccgacacaaggagaagccacgctggtggaagaacaagacacgaactttgtgtgtcgacgaacattcgtggacagaggctggggcaatggttgtggactattcggaaagggtagcttaataacgtgtgctaagtttaagtgtgtgacaaaattggaaggaaagatagtccaatatgaaaacttaaaatattctgtgatcgttaccgtccacactggagaccagcaccaagttggaaatgagaccacagaacatggaacaattgcaaccataacacctcaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggacctcaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggccgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagctggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcatggaacatctgggaagttgaagactatggatttggaattttcacgacaaacatatggttgaaattgcgtgattcctacacccaagtgtgtgaccatcgactaatgtcggctgccatcaaggatagcaaagcagtccatgctgacatggggtactggatagaaagtgaaaagaacgagacttggaagttggcaagagcctccttcatagaagtcaagacatgcgtctggccaaaatctcacactctatggagtaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggaaatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagacgagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacagcgccaggtaccttcaagacttctgaaggcgaagttggagccatagctctagacttcaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcctttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaaggtggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattagaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctttgatagctgtgctgactggtggagtgacgctgttcttcctatcaggaagaggcttagggaaaacatccataggcctactctgcgtgacgtcctcaagtgcactgttatggatggccagtgtggagccccattggatagcggcctctattatactagagttctttctgatggtgttgcttattccagagccagatagacagcgcactccacaagacaaccagttagcatatgtggtgataggtttgctattcatgatattgacagtggcagccaatgagatgggattattggaaaccacaaagaaagacctggggattggtcatgcagctgctgaaaaccaccaccacgccgcaatgctggacgtagacctccatccagcttcagcctggaccctctacgcagtggccacaacgattatcactcccatgatgagacacacaattgaaaacacaacggcaaatatttccctgacagctattgcaaaccaggcagctatattgatgggacttgataagggatggccaatatcaaagatggacataggagttccacttctcgccttggggtgctattctcaagtgaacccgctgacgctgacagcagcggtactgatgctagtagcccattatgccataattggaccaggactgcaagcaaaagccactagagaagctcaaaaaaggacggcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaagttctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcagaatttaacacttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaacctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatatccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgctacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacccagcgaattggaaaccccaaatttagccggaagagtccttgactggttggaaaaacatggcaccgagaggctgagaagaatggcaatcagtggagatgactgtgtggtgaaaccaattgatgacagatttgcaacagccttaacagccttgaatgacatgggaaaggtaagaaaagacataccgcaatgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacaggagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattatctagactacatgacatcaatgaagagattcaaaaacgagagtgatcccgaaggggcactctggtaa

SEQ ID NO: 79 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggtcaaggacccatgaaactggtgatggcttttatagcattcctaagatttctagccatacctccaacagcaggaattttggctagatggggctcattcaagaagaatggagcgattaaagtgttacggggtttcaaaaaagaaatctcaaacatgttgaacataatgaacaggagaaaaagatctgtgaccatgctcctcatgctgctgcccacagtcctgacgttccatttgaccacccgagggggagagcctcacatgatagttagcaaacaggaaagaggaaagtcacttttgtttaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaagggattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaataccaccactgactcgagatgtccgacacaaggagaagccacgctggtggaagaacaagacacgaactttgtgtgtcgacgaacattcgtggacagaggctggggcaatggttgtggactattcggaaagggtagcttaataacgtgtgctaagtttaagtgtgtgacaaaattggaaggaaagatagtccaatatgaaaacttaaaatattctgtgatcgttaccgtccacactggagaccagcaccaagttggaaatgagaccacagaacatggaacaattgcaaccataacacctcaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggacctcaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagctggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagtcggcatggtcacactgtacctaggagtcatggtccaggcggactcgggatgtgtaatcaactggaaaggcagagaactcaaatgtggaagcggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcatggaacatctgggaagttgaagactatggatttggaattttcacgacaaacatatggttgaaattgcgtgattcctacacccaagtgtgtgaccatcgactaatgtcggctgccatcaaggatagcaaagcagtccatgctgacatggggtactggatagaaagtgaaaagaacgagacttggaagttggcaagagcctccttcatagaagtcaagacatgcgtctggccaaaatctcacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggaaatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagacgagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacagcgccaggtaccttcaagacttctgaaggcgaagttggagccatagctctagacttcaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcctttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaaggtggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattagaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctttgatagctgtgctgactggtggagtgacgctgttcttcctatcaggaagaggcttagggaaaacatccataggcctactctgcgtgacgtcctcaagtgcactgttatggatggccagtgtggagccccattggatagcggcctctattatactagagttctttctgatggtgttgcttattccagagccagatagacagcgcactccacaagacaaccagttagcatatgtggtgataggtttgctattcatgatattgacagtggcagccaatgagatgggattattggaaaccacaaagaaagacctggggattggtcatgcagctgctgaaaaccaccaccacgccgcaatgctggacgtagacctccatccagcttcagcctggaccctctacgcagtggccacaacgattatcactcccatgatgagacacacaattgaaaacacaacggcaaatatttccctgacagctattgcaaaccaggcagccatattgatgggacttgataagggatggccaatatcaaagatggacataggagttccacttctcgccttggggtgctattctcaagtgaacccgctgacgctgacagcagcggtactgatgctagtagcccattatgccataattggaccaggactgcaagcaaaagccactagagaagctcaaaaaaggacggcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcagaatttaacacttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaacctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgctacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacccagcgaattggaaaccccaaatttagccggaagagtccttgactggttggaaaaacatggcaccgagaggctgagaagaatggcaatcagtggagatgactgtgtggtgaaaccaattgatgacagatttgcaacagccttaacagccttgaatgacatgggaaaggtaagaaaagacataccgcaatgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacaggagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagctgggaagacgttccatacctagggaaaagggaagatcaatggtgtggatccctaataggcttaacagcacgagccacttgggccaccaacatacaagtggccataaaccaagtgagaaggctcattgggaatgagaattatctagactacatgacatcaatgaagagattcaaaaacgagagtgatcccgaaggggcactctggtaa

SEQ ID NO: 80 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggtcaaggacccatgaaactggtgatggcttttatagcattcctaagatttctagccatacctccaacagcaggaattttggctagatggggctcattcaagaagaatggagcgattaaagtgttacggggtttcaaaaaagaaatctcaaacatgttgaacataatgaacaggagaaaaagatctgtgaccatgctcctcatgctgctgcccacagtcctgacgttccatttgaccacccgagggggagagcctcacatgatagttagcaaacaggaaagaggaaagtcacttttgtttaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaagggattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaataccaccactgactcgagatgtccgacacaaggagaagccacgctggtggaagaacaagacacgaactttgtgtgtcgacgaacattcgtggacagaggctggggcaatggttgtggactattcggaaagggtagcttaataacgtgtgctaagtttaagtgtgtgacaaaattggaaggaaagatagtccaatatgaaaacttaaaatattctgtgatcgttaccgtccacactggagaccagcaccaagttggaaatgagaccacagaacatggaacaattgcaaccataacacctcaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggacctcaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagctggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagtcggcatggtcacactgtacctaggagtcatggtccaggcggactcgggatgtgtaatcaactggaaaggcagagaactcaaatgtggaagcggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcatggaacatctgggaagttgaagactatggatttggaattttcacgacaaacatatggttgaaattgcgtgattcctacacccaagtgtgtgaccatcgactaatgtcggctgccatcaaggatagcaaagcagtccatgctgacatggggtactggatagaaagtgaaaagaacgagacttggaagttggcaagagcctccttcatagaagtcaagacatgcgtctggccaaaatctcacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggaaatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagacgagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacagcgccaggtaccttcaagacttctgaaggcgaagttggagccatagctctagacttcaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcctttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaaggtggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattagaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctttgatagctgtgctgactggtggagtgacgctgttcttcctatcaggaagaggcttagggaaaacatccataggcctactctgcgtgacgtcctcaagtgcactgttatggatggccagtgtggagccccattggatagcggcctctattatactagagttctttctgatggtgttgcttattccagagccagatagacagcgcactccacaagacaaccagttagcatatgtggtgataggtttgctattcatgatattgacagtggcagccaatgagatgggattattggaaaccacaaagaaagacctggggattggtcatgcagctgctgaaaaccaccaccacgccgcaatgctggacgtagacctccatccagcttcagcctggaccctctacgcagtggccacaacgattatcactcccatgatgagacacacaattgaaaacacaacggcaaatatttccctgacagctattgcaaaccaggcagctatattgatgggacttgataagggatggccaatatcaaagatggacataggagttccacttctcgccttggggtgctattctcaagtgaacccgctgacgctgacagcagcggtactgatgctagtagcccattatgccataattggaccaggactgcaagcaaaagccactagagaagctcaaaaaaggacggcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcagaatttaacacttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaacctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgctacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacccagcgaattggaaaccccaaatttagccggaagagtccttgactggttggaaaaacatggcaccgagaggctgagaagaatggcaatcagtggagatgactgtgtggtgaaaccaattgatgacagatttgcaacagccttaacagccttgaatgacatgggaaaggtaagaaaagacataccgcaatgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacaggagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagctgggaagacgttccatacctagggaaaagggaagatcaatggtgtggatccctaataggcttaacagcacgagccacttgggccaccaacatacaagtggccataaaccaagtgagaaggctcattgggaatgagaattatctagactacatgacatcaatgaagagattcaaaaacgagagtgatcccgaaggggcactctggtaa

SEQ ID NO: 81 - DNA, 10179 bp, Dengue virus; identical to SEQ ID NO: 80

SEQ ID NO: 82 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaattggtgatggcttttatagcattcctaagatttctagccatacctccaacagcaggaattttggctagatggagctcattcaagaagaatggagcgatcaaagtgttacggggtttcaagaaagagatctcaaacatgttgaacataatgaacaggaggaaaagatctgtgaccatgctcctcatgctgctgcccacagccctagcgtttcatctgaccacccggggaggagagccgcacatgatagttagcaagcaggaaagaggaaaatcacttttgtttaagacctctgcaggtgtcaacatgtgtacccttattgcaatggatttgggagagttatgtgaggacacaatgacctacaaatgccccaggatcactgagacggagccagatgacgttgactgttggtgcaatgccacggagacatgggtgacctatggaacatgttctcaaactggtgaacaccgacgagacaaacgttccgtcgcattggcaccacacgtagggcttggcctagaaacaagaaccgaaacgtggatgtcctctgaaggcgcttggagacaaatacaaaaagtggagacttgggctctgagacacccaggattcacggtgatagccttttttctagcacatgctataggaacatccatcacccagaaagggattatttttattttgctgatgctggtaactccatccatggccatgcggtgcgtgggaataggcaacagagacttcgtggaaggactgtcaggagctacgtgggtggatgtggtactggagcatggaagttgcgtcactaccatggcaaaagacaaaccaacactggacattgaactcctgaagacggaggtcacaaaccctgcagtcctgcgcaaactgtgcattgaagctagaatatcaaacaccaccaccgattcgagatgtccaacacaaggagaagctacgctggtggaagagcaggacacgaactttgtgtgccgacgaacgttcgtggacagaggctggggcaatggttgtgggctattcggaaaaggtagcttaataacgtgtgctaagtttaagtgcgtgacaaaactggaaggaaagatagtccaatatgaaaacttaaaatattcagtcatagtcaccgtacacactggagaccaacaccaagttggaaatgagaccacagaacatggaacaactgcaaccataacacctcaagctcccacgtcggaaatacagctgacagactacggagctctaacattggattgttcacctagaacaggactagactttaatgagatggtgttgttgacaatgaaagaaaaatcatggctcgtccacaaacaatggtttctggacctaccactgccttggacctcgggggcctcaacatcccaagagacttggaatagacaagacttgctggtcacatttaagacagctcatgcaaaaaagcaggaagtagtcgtactaggatcacaagaaggagcaatgcacactgcgctgactggagcgacagaaatccaaacgtctggaacgacaacaatttttgcaggacacctgaaatgtagactaaaaatggataaactgaccttaaaaggggtatcatatgtaatgtgcacagggtcattcaagctagagaaggaagtggctgagacccagcatggaactgttctagtgcaggttaaatacgaaggaacagatgcaccatgcaagatccccttctcgtcccaagatgagaggggagtaacccagaatgggagattgataacagccaaccccatagtcactgacaaagaaaaaccagtcaacattgaagcggagccaccttttggtgagagctaccttgtggtaggagcaggtgaaaaagctttgaaactaagctggttcaagaagggaagcagtatagggaaaatgtttgaagcaactgcccgtggagcacgaaggatggccatcctgggagacaccgcatgggacttcggttctataggaggggtgttcacgtctgtgggaaaactgatacaccagatttttgggaccgcgtatggagtcttgttcagcggggtttcatggaccatgaaaataggaatagggattctactgacatggctaggattaaattcaaggagcacgtccctttcaatgacgtgtatcgcagttggcatggtcacactgtacctaggagtcatggttcaggcggactcgggatgtgtaatcaactggaaaggcagagaactcaaatgtggaagcggcatttttgtcaccaatgaagtccacacctggacagagcaatacaaattccaggccgactcccccaagagactatcagcggccatagggaaggcatgggaggagggtgtgtgtggaattcgatcagccactcgtctcgagaacatcatgtggaagcaaatatcaaatgaattaaaccacatcttacttgaaaatgacatgaaatttacagtggtcgtaggagacgttaatggagtcttggcccaaggaaagaaaatgattaggccgcaacccatggaacacaaatactcgtggaaaagctggggaaaagccaaagtcataggagcagatgtacaaaatatcaccttcatcatcgacggcccaaacaccccagaatgccctgatgatcaaagagcatggaatatctgggaagtcgaagactatggatttggaattttcacgacaaacatatggttgaaattgcgtgactcctacactcaagtgtgtgaccaccggctaatgtcagctgccatcaaggatagcaaagcagtccacgctgacatggggtactggatagaaagtgaaaagaacgagacttggaagttgacaagagcctccttcatagaagttaagacatgcatctggccaaaatcccacaccctatggagcaatggagtcttggaaagtgagatgataatcccaaagatatatggaggaccaatatctcagcacaactacagaccaggatatttcacacaaacagcagggccatggcacttgggcaagttagaactggattttggtttgtgtgaaggtaccactgttgttgtggatgaacattgtggaaatcgaggaccatctctaagaaccacaacagtcacaggaaagataatccatgaatggtgctgtagatcttgcacgttaccccccctacgtttcaaaggagaagacgggtgctggtacggtatggaaatcagaccagtcaaggagaaggaagagaacctagtcaagtcaatggtctctgcagggtcaggagaagtggacagtttttcactaggactgctatgcatatcaataatgatcgaagaggtaatgagatccagatggagcagaaaaatgctgatgactggaacattggctgtgttcctccttcttataatgggacaattgacatggaatgatctgatcaggctatgtatcatggttggagccaatgcttcagacaagatggggatgggaacaacgtacctagctttgatggccaccttcagaatgagaccaatgttcgcagtcgggctactgtttcgcagattaacatctagagaagttcttcttcttacagttggattgagtctagtggcatctgtagaactaccaaattccttggaggagctaggggatggacttgcaatgggcatcatgatgttgaaattattgactgattttcagtcacatcagctatgggctgccttgctgtctttaacatttgtcaaaacaactttttcactgcactatgcatggaagacaatggctatgatactgtcaattgtatctctcttccctttatgcctgtccacgacttctcaaaaaacaacatggcttccggtgttgctgggatctcttggatgcaaaccactaaccatgtttcttattacagaaaacaaaatctggggaaggaaaagctggcctctcaatgagggaattatggctgttggaatagttagcattcttctaagttcacttctcaaaaatgatgtaccactagctggcccactaatagctggaggcatgctgatagcatgttatgtcatatctggaagctcggcagatttatcactggagaaagcggctgaggtctcctgggaagtagaagcagaacactctggtgcctcacacaacatactagtggaggtccaagatgacggaaccatgaagataaaagatgaagagagagatgacacacttaccatcctcctcaaagcaactttgctagcaatctcaggggtatacccaatgtcaataccggcgaccctctttgtgtggtatttttggcagaaaaagaaacagagatcaggagtgctatgggacacacccagccctccagaagtggaaagagcagtccttgatgatggcatctatagaattctccaaagaggactgttgggcaaatctcaagtaggagtaggagtttttcaagaaggtgtattccacacaatgtggcacgtcaccaggggagctgtcctcatgtaccaagggaagagattggaaccaagttgggccagtgtcaaaaaagacttgatctcatatggaggaggttggaggtttcaaggatcctggaacatgggagaagaagtgcaggtgattgctgttgaaccggggaagaaccccaaaaatgtgcagacagcgccaggtacctttaagacccctgaaggtgaagttggagccatagctctagactttaaacccggcacatctggatctcctattgtgaacagagagggaaaaatagtaggtctttatggaaatggagtggtgacaacaagtggaacctacgtcagtgccatagctcaagccaaagcatcacaagaagggcctctaccagagattgaggatgaggtgtttaggaaaagaaacttgacaataatggacctacatccaggatcgggaaaaacaagaagataccttccagccatagtccgtgaggctataaaaagaaagctacgcacgctagtcttagctcccacaagagttgtcgcctctgaaatggcagaggcgctcaagggaatgccaataaggtaccagacaacagcagtgaaaagtgaacacacgggaaaggagatagttgaccttatgtgtcacgctacttttaccatgcgtctcctctcccctgtgagagttcccaattataatatgattatcatggatgaagcacatttcactgatccggccagcatagcagccagagggtatatctcaacccgagtgggtatgggtgaagcagctgcaattttcatgacagccactccccccggatcgatggaggcctttccacagagcaatgcagctatccaagatgaggaaagagacattcctgaaaggtcttggaactcaggctatgactggattactgatttcccaggtaaaacagtttggtttgttccaagcatcaaatcaggaaatgacattgccaactgtttaagaaagaatgggaaacgggtggtccaattgagcagaaaaacctttgacactgagtaccagaagacaaaaaataacgactgggactatgttgtcacaacagacatatccgaaatgggagcaaacttccgagctgacagggtaatagacccaaggcggtgcctaaaaccggtaatactaaaagatggcccagagcgtgtcattctagccggaccgatgccagtgactgtggctagcgccgcccagaggagaggaagaattggaaggaaccaaaataaggaaggtgatcagtatatttacatgggacagcctctaaacaatgatgaggaccatgcccattggacagaagcgaaaatgctccttgacaacataaacacaccagaagggattatcccagccctctttgagccggagagagaaaagagtgcagcaatagacggggaatacagactacggggtgaagcgaggaaaactttcgtggagcttatgagaagaggagatctacctgtctggctatcctacaaagttgcctcagaaggcttccagtactccgacagaaggtggtgctttgatggagaaaggaacaaccaagtgctggaggagaacatggacgtggagatctggacaaaagaaggagaaagaaagaaactacgacctcgctggctggatgccagaacatactctgacccactggctctgcgcgaattcaaagagttcgcagcaggaagaagaagcgtctcaggtgacctaatattagaaatagggaaacttccacaacatctaacgcaaagggcccagaatgccttggacaacctggttatgctgcacaactctgaacagggaggaaaagcctatagacacgccatggaagaactaccagacactatagaaacgttaatgcttctggctttgatagctgtgctgactggtggggtgacgttgttcttcctatcaggaaggggtctaggaaaaacatccattggtctactctgcgtgatggcctcaagtgcactgttatggatggccagtgtggaaccccattggatagcggcctctatcatactggagttctttctgatggtgttgcttattccagaaccggacagacagcgcactccacaagacaaccagctagcatacgtggtgataggtctattattcatgatattgacagtggcagccaatgagatgggattactggaaaccacaaagaaggacctagggattggtcatgtggctgctgaaagccaccaccatgctgcaatgctggacgtagacctacatccagcttcagcctggaccctctatgcagtggccacaacaattatcactcccatgatgagacacacaattgaaaacacaacggcaaacatttccctgacagctatcgcaaaccaggcagctatattgatgggacttgacaagggatggccaatatcaaagatggacataggagttccccttcttgccttggggtgctattctcaggtgaacccgctgacgctgacagcggcggtgttgatgctagtggctcattacgctataattggacccggactgcaagcaaaagctactagagaagctcaaaaaaggacagcagctggaataatgaaaaacccaactgtcgatgggatcgttgcaatagatttggaccctgtggtttacgatgcaaaatttgaaaaacagctaggccaaataatgttgttgatactttgcacatcacagattctcctgatgcggaccacatgggccttgtgtgaatccatcacactagccactggacctctgaccacactctgggagggatctccaggaaaattctggaacaccacgatagcggtgtccatggcaaacatttttaggggaagttatctagcaggagcaggtctggccttttcattaatgaaatctctaggaggaggtaggagaggcacgggagcccaaggggaaacactgggagaaaaatggaaaagacagctaaaccaattgagcaagtcagaattcaacacttacaaaaggagtgggatcatagaggtggatagatctgaagccaaagaggggttaaaaagaggagaaacgactaaacacgcggtgtcgagaggaacggccaaactgaggtggtttgtagagaggaaccttgtgaaaccagaagggaaagtcatagacctcggttgtggaagaggtggctggtcatattactgcgctgggctgaagaaagtcacagaagtgaaaggatacacgaaaggaggacctgggcatgaggaaccaattccaatggcaacctatggatggaacctagtaaaactatactccgggaaagatgtattctttacaccacctgagaaatgtgacacccttttgtgcgatattggtgagtcctctccgaacccaaccatagaagaaggaagaacgttacgagttctaaagatggtggaaccatggctcagaggaaaccaattttgcataaaagttctaaatccctatatgccgagcgtggtagaaactttggagcaaatgcaaagaaaacatggaggaatgctagtgcgaaatccactctcaagaaactccactcatgaaatgtactgggtttcatgtggaacaggaaacattgtgtcagcagtaaacatgacatctagaatgctgctaaatcgattcacaatggctcacaggaagccaacatatgaaagagacgtggacttaggcgctggaacaagacatgtggcagtagaaccagaggtggccaacctagatatcattggccagaggatagaaaatataaaaaatgaacacaaatcaacatggcattatgatgaggataatccatacaaaacatgggcctatcatggatcatatgaggtcaagccatcaggatcagcctcatccatggtcaatggtgtggtgagactgctaaccaaaccatgggatgtcatctccatggtcacacaaatagccatgactgacactacaccctttggacaacagagggtgttcaaagagaaagttgacacgcgcacaccaaaagcgaaacgaggcacagcacaaatcatggaggtgacagccaggtggttatgggggtttctctctagaaacaaaaaacccagaatttgtacaagagaggagttcacaagaaaagtcaggtcaaacgcagccattggagcagtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaattaggagagtttggaaaggcaaaaggaagtcgcgcaatatggtacatgtggttgggagcgcgctttttagagtttgaagcccttggtttcatgaatgaagatcactggttcagcagagagaattcactcagtggagtggagggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaacaaggtagtaagggtgcagagaccagcaaaaaatggaaccgtgatggatgtcatatccagacgtgaccagagaggaagtggacaggttggaacctatggcttaaacaccttcaccaacatggaggcccaactaataagacaaatggaatctgagggaatctttttacccagcgaattggaaaccccaaatctagctgaaagagtccttgactggttggaaaaacatggcatcgagaggctgaaaagaatggcaatcagtggagatgactgtgtggtgaaaccaattgatgacagatttgcaacagccttaacagctttgaatgacatgggaaaggtaagaaaagacataccacaatgggaaccttcaaaaggatggaatgattggcaacaagtgcctttctgttcacaccatttccaccagctgatcatgaaggatgggagggagatagtggtgccatgccgcaaccaagatgaacttgtgggtagggccagagtatcacaaggcgccggatggagcctgagagaaactgcatgcctaggcaagtcatatgcacaaatgtggcagctgatgtacttccacaggagagacttgagattagcggctaatgctatctgttcagccattccggttgattgggtcccaaccagccgcaccacctggtcgatccatgcccaccaccaatggatgacaacagaagacatgttgtcagtgtggaatagggtctggatagaggaaaacccatggatggaggacaaaactcatgtgtccagttgggaagacgttccatacctaggaaaaagggaagatcaatggtgtggatccctaataggcttaacagcacgagccacctgggccaccaacatacaagtggccataaaccaagtgagaaggctcattgggaatgagaattatctagactacatgacatcaatgaagagattcaaaaacgagagtgatcccgaaggggcactctggtaa

SEQ ID NO: 83 - DNA, 10179 bp, Dengue virus
atgaacaaccaacggaaaaagacgggtcgaccgtctttcaatatgctgaaacgcgcgagaaaccgcgtgtcaactgtttcacagttggcgaagagattctcaaaaggattgctttcaggtcaaggacccatgaaactggtgatggcttttatagcattcctaagatttctagccatacctccaacagcaggaattttggctagatggggctcattcaagaagaatggagcgattaaagtgttgcggggtttcaaaaaagaaatctcaaacatgttgaacataatgaacaggagaaaaagatctgtgaccatgctcctcatgctgctgcccacagtcctgacgttccatttgaccacccgagggggagagcctcacatgatagttagcaaacaggaaagaggaaagtcacttttgtttaagacccctgcaggtgtcaacatgtgcacccttattgcaatggacctgggagagttatgtgatgacacgatgacctacaaatgtccccggatcactgagacggaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaagggattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaataccaccactgactcgagatgtccgacacaaggagaagccacgctggtggaagaacaagacacgaactttgtgtgtcgacgaacattcgtggacagaggctggggcaatggttgtggactattcggaaagggtagcttaataacgtgtgctaagtttaagtgtgtgacaaaattggaaggaaagatagtccaatatgaaaacttaaaatattctgtgatcgttaccgtccacaatggagaccagcaccaagttggaaatgagaccacagaacatggaacaattgcaaccataacacctcaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggacctcaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagctggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcatggaacatctgggaagttgaagactatggatttggaattttcacgacaaacatatggttgaaattgcgtgattcctacacccaagtgtgtgaccatcgactaatgtcggctgccatcaaggatagcaaagcagtccatgctgacatggggtactggatagaaagtgaaaagaacgagacttggaagttggcaagagcctccttcatagaagtcaagacatgcgtctggccaaaatctcacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggtcgtggatgaacattgtggaaatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagacgagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacagcgccaggtaccttcaagacttctgaaggcgaagttggagccatagctctagacttcaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcctttccacagagcaatgcagttatccaagatgaggaaaaagacattcctgaaagatcatggaactcaggctatgactggatcacagacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaaggtggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattagaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctttgatagctgtgctgactggtggagtgacgctgttcttcctatcaggaagaggcttagggaaaacatccataggcctactctgcgtgacgtcctcaagtgcactgttatggatggccagtgtggagccccattggatagcggcctctattatactagagttctttctgatggtgttgcttattccagagccagatagacagcgcactccacaagacaaccagttagcatatgtggtgataggtttgctattcatgatattgacagtggcagccaatgagatgggattattggaaaccacaaagaaagacctggggattggtcatgcagctgctgaaaaccaccaccacgccgcaatgctggacgtagacctccatccagcttcagcctggaccctctacgcagtggccacaacgattatcactcccatgatgagacacacaattgaaaacacaacggcaaatatttccctgacagctattgcaaaccaggcagctatattgatgggacttgataagggatggccaatatcaaagatggacataggagttccacttctcgccttggggtgctattctcaagtgaacccgctgacgctgacagcagcggtactgatgctagtagcccattatgccataattggaccaggactgcaagcaaaagccactagagaagctcaaaaaaggacggcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcagaatttaacacttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaacctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgctacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacccagcgaattggaaaccccaaatttagccggaagagtccttgactggttggaaaaacatggcaccgagaggctgagaagaatggcaatcagtggagatgactgtgtggtgaaaccaattgatgacagatttgcaacagccttaacagccttgaatgacatgggaaaggtaagaaaagacataccgcaatgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacaggagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattatctagactacatgacatcaatgaagagattcaaaaacgagagtgatcccgaaggggcactctggtaa

SEQ ID NO: 84 - DNA, 10179 bp, Dengue virus
atgaacaaccaacgaaaaaagacgggtcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagaatggagcgattaaagtgttacgaggtttcaaaaaagagatctcaaacatgttaaacataatgaacaggagaaaaagaaccgtgaccatgctccttatgctgctgcccacggccctggcgttccatctgactacaagagggggagagccgcacatgatagttaacaagcaggaaagaggaaagtcactcttgtttaagacctctgcaggtgtcaacatgtgcacccttattgcgatggatttgggagagttatgtgaggacacaatgacctacaaatgcccccggattactgaggcggaaccagatgacgttgactgttggtgcaatgccacggacacatgggtgacctatggaacgtgttctcaaaccggtgaacaccgacgagacaaacgttctgtggcactggccccacatgtggggcttggtctggaaacaagagccgaaacgtggatgtcctctgaaggcgcttggaaacaaatacaaaaagtggagacttgggctctgagacacccaggattcacggtgatagccctttttctagcacatgccataggaacatccatcacccagaaagggattattttcattctgttgatgctggtaacaccatccatggccatgcgatgtgtgggagtaggcaacagagacttcgtggaaggactgtcaggggcaacgtgggtggatgtggtactagagcacggaagttgcgttaccactatggcaaaaaataaaccaacactggacattgaacttctgaagacagaggttacaaaccctgctgtcttgcgtaaactgtgcattgaagctaaaatatcaaacaccaccaccgattcaagatgcccaacacaaggagaagccacactggtggaagaacaagacgcgaactttgtgtgccgacgaacgtttgtggacagaggctggggcaatggctgtggactattcggaaaaggtagcttaataacgtgtgctaagtttgagtgtgtgacaaaactagaaggaaagatagttcaatatgaaaacctaaaatattcagtgatagtcaccgtccacactggagaccaacaccaggtaggaaatgagactacaggacatggaacaactgcaaccataacacctcaagctcccacgtcggaaatacagctgaccgattacggagctctcacattggattgttcacctagaacagggctagactttaatgagatggtgttgttgacaatgaaagaaaaatcatggcttgtccacaaacaatggtttctagacctaccactgccttggacctcgggggcttcaacatcccaggagacttggaacagacaggacttgctggttacatttaagacagcccatgcaaagaagcaggaagtagtcgtactaggatcccaagaaggagcaatgcacactgcgttgactggagcgacagaaatccaaacgtcaggaacgacaacaatttttgcaggacacctgaaatgcagactaaaaatggataaactgactttaaaagggatgtcatatgtgatgtgcacaggctcattcaagttagaaaaagaagtggctgagacccagcatggaaccgttctagtgcaggttaaatatgaaggaacagatgcaccatgcaagatccccttttcgacccaagatgagaaaggaataacccagaatgggaggttgataacagccaaccccatagtcactgacaaagaaaaaccagtcaacattgaggcagaaccaccttttggtgagagctacatcgtggtaggagcaggtgaaaaagctttgaaactaagctggttcaagaagggaagcagcatagggaaaatgttcgaagcaaccgcccgaggagcacgaaggatggccatcttgggagacaccgcatgggacttcggttctataggaggagtgtttacgtctgtgggaaaactggtacaccaaatttttggaactgcatatggggttttgttcagcggcgtttcctggaccatgaaaataggaatagggatcctgctgacatggctgggattgaattcaaggagcacttccctttcgatgacatgcatcgcagttggcatggtcacactgtatctaggagtcatggttcaggcggactcgggatgtgtaatcaactggaaaggcagagaactcaaatgtggaagtggcatttttgtcaccaacgaagttcacacttggacagagcaatacaaattccaggctgactccccaaaaagactatcagcagccattgggaaagcatgggaggagggtgtgtgtggaattcgatcagccactcgtcttgagaacatcatgtggaagcaaatatcaaatgaattgaatcacatcctacttgaaaatgacatgaaattcacagtggtcgttggggatgttagtggaatcctggcccaagggaaaaaagtgattaggccacaacccatggaacacaaatactcatggaaaagctggggaaaagctaagatcataggagcagatgtacagaacaccaccttcatcatcgacggcccaaacaccccagaatgccctgatagccaaagagcatggaatatttgggaagttgaggactatggatttggaattttcaccacaaacatatggttaaaactgcgtgactcctacacccaagtgtgtgaccatcggctaatgtcagccgccatcaaggacagcaaagcagttcatgctgacatggggtactggatagaaagtgaaaagaacgagacctggaagttagcgagagcttccttcatagaagtaaagacatgcacttggccaaaatcccacaccctatggagcaatggagttctggaaagtgaaatgataatcccaaagatatatggaggaccaatatctcagcacaactacagaccaggatacttcacacaaacagcagggccgtggcacctaggcaagttggaactagattttgatttgtgtgaaggcaccacggttgttgtggatgaacattgtggaaatcgaggtccatctcttagaaccacaacagtcacaggaaagataatccatgaatggtgttgtagatcttgtacgttaccccccttacgtttcaaaggagaagatggatgttggtatggcatggaaatcagacccgtcaaggagaaggaagagaacctagtcaggtcaatggtttctgcagggtcaggagaagtggacagtttttcattaggactactatgcatatcaataatgattgaagaggtgatgagatctagatggagcagaaaaatgctgatgactggaacattggttgtgttcctccttctcataatgggacaactgacatggagtgatctgatcagattatgtatcatggttggagccaatgcctcagacaggatggggatgggaacaacgtacctagctttgatggccactttcaaaatgagaccaatgttcgctgttgggctactatttcgcagactaacatctagagaagttcttcttctcacaattggattaagcctggtggcatccgtggatctaccaaattccttagaggagctgggggatggactagcaatgggcatcatgatgttaaaattactgactgactttcagtcacatcagttatgggctaccttgctgtctttgacatttatcaaaacaactctttcgttgcattatgcatggaagacaatggctatggtgctgtcaattgtgtccctcttccctctatgcctgtctacgacctctcaaaaaacaacatggctcccggtgctgctaggatcttttggatgcaaaccactaaccatgtttcttataacagaaaataaaatctggggaaggaaaagttggcccctcaatgaaggaattatggctgttggaatagttagcattctactaagttcacttctcaaaaatgatgtgccgctagccggcccactaatagctggaggcatgctaatagcatgttatgtcatatccggaagctcagctgacttgtcattggagaaagcggctgaggtctcctgggaagaagaagcagaacactctggtgcctcacacaacatattagtggaggtccaagatgatggaaccatgaagataaaagatgaagagagagatgacacactcaccatactccttaaagcaactctgctggcagtgtcaggggtgtacccaatgtcaataccagcgacccttttcctgtggtatttttggcagaaaaagaaacagagatcaggagtgctatgggacacaccaagccctccagaggtagaaagggcagttcttgatgatggtatctatagaattttgcaaagaggactgttgggcaggtcccaagtaggagtgggagtttttcaagaaggcgtgttccacacaatgtggcatgtcaccaggggagctgtcctcatgtatcaagggaagaggctggaaccaagttgggccagtgtcaaaaaagatttgatctcatatggaggaggttggaggcttcaaggatcctggaacacgggagaagaagtgcaggtgattgctgttgaacccaggaaaaacccaaaaaatgtacagacaatgccgggcacttttaagacccctgaaggcgaagttggagccatagccctggattttaaacccggcacatctggatctcccatcgtgaatagagaggggaaaatagtaggtctttatggaaatggagtggtgacaacaggtggaacctacgtcagtgccatagctcaagccaaaacgtcacaagaagggcctctaccagagattgaggacgaggtgtttagaaaaagaaacttaacaataatggacctacatccaggatcggggaaaacaagaagatatcttccagctatagtccgtgaggccataaagaggaagctgcgcacgctaatcttggctcccacaagagttgtcgcttctgaaatggcagaggcgctcaagggaatgccaataaggtaccagacaacagctgtgaagagtgaacacacaggaaaggagatagttgacctcatgtgccacgccactttcaccatgcgcctcctgtctcccgtgagagttcccaattataacatgattattatggatgaagcacatttcactgatccagccagcatagcggccagagggtacatctcaacccgagtgggtatgggtgaagcagctgcgatctttatgaccgccacccccccaggatcggtagaggcctttccacagagcaatgcagtcatccaagacgaggaaagagatattcccgagagatcatggaactcaggctatgactggatcactgatttcccaggtaagacagtttggtttgttccaagcatcaaagcaggaaatgacattgccaactgtttaagaaagaacggaaaacgggtgatccaattgagcagaaaaacctttgacactgagtaccagaaaactaagaataacgactgggactatgtcgtgacaacagacatctccgaaatgggagcaaatttccgggccgacagggtaatagacccaaggcggtgtctgaaaccagtaatactaaaagatggtccagagcgcgtcattctagccggaccgatgccagtgactgtagccagtgccgctcagaggagaggaagaattggaaggaaccaaaacaaggaaggtgatcagtatatctatatgggacagccattaaacaatgatgaggaccacgctcattggacagaagcaaaaatgctccttgacaatataaacacaccagaagggatcatcccagctctctttgagccggagagagaaaagagtgcagcaatagacggggaatacagactgcggggtgaagcaaggaaaacgttcgtggagcttatgagaagaggagatctacctgtctggttatcctacaaagttgcctcagaaggcttccagtactccgacagaaggtggtgctttgatggggaaaggaacaaccaggtgttggaggagaacatggacgtggagatctggacaaaagaaggagaaagaaagaaactacgaccccgctggttggatgccagaacatactctgacccactggctctacgcgagtttaaagagtttgcagcaggaagaagaagcgtctcaggtgacctaatattagaaatagggaaacttccacaacacttgacgcaaagagcccagaatgctttggacaacttggtcatgttgcacaattccgaacaaggaggaaaagcctacagacacgctatggaagagctaccagacaccatagaaacattgatgctcctagctttgatagccgtgttgactggtggagtgacgctgttcttcctatcaggaagaggcctagggaaaacatccatcggcctactctgcgtgatggcctcaagtgtactgttatggatggccagtgtggagccccactggatagcggcctccatcatattggagttttttctgatggtgctgcttattccagagccagacagacagcgcactccacaggacaatcagctagcatatgtggtgataggtttgttattcatgatactgacagtggcagccaatgagatgggattattggaaaccacaaagaaagatctggggataggccacgtagctgctgaaaaccaccaccatgccacaatgctggacgtagatctacatccagcctcagcctggaccctctatgcagtggccacaacaatcattactcccatgttgagacatacaattgaaaatacaacggcaaatatttccctgacagctattgcaaaccaggcagctatattgatgggacttgacaagggatggccaatatcgaagatggacataggagttccacttcttgctttggggtgctattcccaggtgaacccactgacgttgatagcggcggtgttgatgctagtggctcattatgccataattggacctggactgcaagcaaaagctactagagaagctcaaaaaaggacagcagccggaataatgaaaaatccaactgttgatgggattgtcgcaatagatttggatcctgtggtttacgacgcaaaatttgaaaaacagctaggccaaataatgttgttaatactttgcacatcacagattctcttgatgcggaccacatgggccttgtgcgaatccatcacactggctactggacctctgaccacgctttgggagggatctccaggaaaattctggaacaccacgatagcggtgtccatggcaaacattttcaggggaagttatctagcaggagcaggtctggctttttcgttaatgaaatctctaggaggaggtaggagaggaacaggagcccaaggggaaacactaggagaaaaatggaaaagacagctaaaccaactgagcaaatcagaattcaacacttacaaaaggagtggtattgtggaagtggatagatccgaagccaaagagggactaaaaagaggagaaacaaccaaacatgcagtatcgagaggaacagccaagctgaggtggtttgtggagaggaacctcgtgaaaccagaagggaaagtcatagacctcggttgcggaaggggtggctggtcatattattgcgctgggctgaagaaagtcacagaagtgaaaggatacacaaaaggaggacctggacatgaggaaccaatcccaatggcgacttatggatggaacctagtaaagctacactccggaaaagatgtattcttcacaccacctgagaaatgtgatacccttttgtgtgatattggtgagtcctctccaaatccaactatagaagaaggaaggaccctacgtgttctaaagatggtggaaccatggctcagaggaaaccaattctgcataaaaattctaaatccctatatgcctagtgtggtagaaactctggaacgaatgcaaagaaaacatggagggatgctagtgcgaaacccactctcaagaaattccacccatgaaatgtactgggtttcatgtggaacaggaaacattgtgtcagcagtaaacatgacatccagaatgttgctgaatcggttcacaatgacacacaggaaaccaacatatgaaagagacgtggacttgggcgctggaacaagacatgtggcagtggaaccagaggtagccaatctagatatcattggccagaggatagagaatataaaaaatgaacacaagtcaacatggcactatgatgaggacaatccatacaaaacatgggcctatcatggatcatatgaggtcaagccatcaggatcagcctcatccatggtcaatggcgtggtgagattgctcaccaaaccatgggatgttatccctatggtcacacaaatagccatgactgacaccacaccctttggacaacagagggtgttcaaagagaaagttgacacgcgcacaccaaaagcaaaacgaggcacagcgcaaattatggaggtgacggccaggtggttatggggattcctttctagaaacaaaaaacccagaatctgcacaagagaggagttcataagaaaagtcaggtcaaacgcagcaattggagcagtatttgttaatgaaaaccaatggaactcagcaaaagaagcagtggaagacgaacggttctgggaccttgtgcacagagagagggagcttcataaacagggaaaatgtgccacgtgtgtctacaatatgatggggaagagagagaaaaaattgggagagtttggaaaggcaaaaggaagtcgtgcaatatggtacatgtggttgggagcacgctttctagagttcgaagctcttggtttcatgaatgaagatcactggttcagtagagagaattcactcagtggagtggaaggagaagggctccacaaacttggatacatacttagagacatatcaaagattccagggggaaatatgtatgcagatgacacagctggatgggacacaagaataacagaggatgatcttcaaaatgaggccaaagtcactgacatcatggagcccgaacatgctctattggccacgtcaatctttaagctgacttaccaaaacaaggtggtaagggtgcagagaccagcaaaaaatggaaccgtgatggatgttatatccagacgagaccagagaggaagcggacaggtcggaacttatggcttgaacaccttcaccaacatggaggcccaactaataagacaaatggagtctgagggaatcttttcacccaacgaattggaaacccctaatttagccgaaagagttcttgactggttggaaaaacatggtgtcgaaaggctgaaaagaatggcaattagcggagatgactgcgtggtgaaaccaattgatgacaggtttgcaacagccttgacagctttgaatgacatgggaaaagttaggaaagacataccgcaatgggaaccctcaaaaggatggaacgattggcaacaagtacctttctgttcacaccatttccaccagctgatcatgaaagacgggagggaaatagtggtaccatgccgcaatcaagatgaacttgtgggtagggctagagtatcacaaggcgccgggtggagcctgagagaaaccgcatgcctaggcaagtcatacgcacaaatgtggcagctgatgtactttcacaggagagacttgagattggcggctaatgctatctgttcagccgttccagttgattgggtcccaaccagccgcaccacctggtcgatccatgcccaccatcaatggatgacaacagaagacatgttatcagtgtggaatagggtttggatagaggaaaacccatggatggaggataaaactcatgtgtccagttgggaggatgttccatacctagggaaaagggaagatcagtggtgtggatccctgataggcttaacagcaagggccacctgggccaccaatatacaagtagccataaaccaagtgagaaggctcattgggaatgagaattatttagactacatgacatcaatgaagagattcaagaatgagagtgatcccgaaggggcgctctggtaa

SEQ ID NO: 85 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggttttaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcatatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccactaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacagagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacgctatacttaggagttatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaagcagttcacgctgacatggggtactggatagaaagtgaaaagaacgagacctggaagctggcaagagcctctttcatagaagtcaaaacgtgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactcctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggccaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactccttaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgatacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcagctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccataataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaagggcttagggaaaacatctatcggccttctctgcgtgatggcttcaagcgtactgctatggatggccagtgtagagccccattggatagcggcctccatcatactggagttcttcctgatggtgctgcttattccagagccagacagacaacgcactccgcaggataaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccagtcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaatgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgattccgaaggggcactctggtga

SEQ ID NO: 86 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcctggaaacagatacaaagagtggagacttgggccctgagacacccaggattcacgatgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctactttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcttttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacgccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 87 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccttttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctattaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcactaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaaaatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 88 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttagcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggctacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagataaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggctccataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacagcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggtagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 89 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagtcttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtgcaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggctagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgccgcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggctttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggattgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 90 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccttttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagtcaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaataccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaattttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaatcagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 91 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgtaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctgggagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctattggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacgcgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 92 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccttttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcactaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtgggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 93 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccttttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggtctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatggtagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtatttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctggattacatgacatcaatgaagagattcaagaacgagagtgatcccgaaggggcactctggtga

SEQ ID NO: 94 - DNA, 10179 bp, Dengue virus; identical to SEQ ID NO: 91

SEQ ID NO: 95 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcattggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagctgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 96 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcaacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggactatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctgggagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacgcgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 97 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggcaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtgcaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggctagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgccgcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttatcccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 98 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagttcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacattgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccaacatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacatacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcttgggaagaagaagcagaacactctggtgcctcacacaacatattagtggaggtccaagatgatggaaccatgaagataaaggatgaagagagagatgacacgctaactattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcggtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 99 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcatcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcacatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgcccactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 100 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaactagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgctttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagctggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 101 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagtacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatgatctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagagcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaaactaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcttaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 102 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccttttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcactaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 103 - DNA, 10179 bp, Dengue virus; identical to SEQ ID NO: 86

SEQ ID NO: 104 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcctggaaacagatacaaagagtggagacttgggccctgagacacccaggattcacgatgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcttttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacgccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagctgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 105 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttagcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctggcatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaatcgaggaccatcccttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacttcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcattctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtcacccgtgagagttcccaattacaacatgattatcatggatgaagcacatttcaccgatccatccagtatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacagcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggtagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 106 - DNA, 10179 bp, Dengue virus; identical to SEQ ID NO: 104

SEQ ID NO: 107 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgtaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggagtaggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgctcacctagaacaggactagactttaatgaaatggtgttgttgacaatgaaagaaaaatcatggctagtccacaaacaatggtttctagacctaccactgccttggacctcgggagctttaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctgggagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgtttcacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaaggcatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacgcgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 108 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccttttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggctactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 109 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccctcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccaaatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctgggagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataacataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacgcgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 110 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggttttaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacgctatacttaggagttatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacgtgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgttggtacggaatggaaatcagaccagtcaaggaaaaggaagagaatctagtcaaatcaatggtctctgcagggtcaggggaagtggacagcttttcactaggactcctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggccaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgatacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcagctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatttccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggccttctctgcgtgatggcttcaagcgtactgctatggatggccagtgtagagccccattggatagcggcctccatcatactggagttcttcctgatggtgctgcttattccagagccagacagacaacgcactccgcaggataaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccagtcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgattccgaaggggcactctggtga

SEQ ID NO: 111 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcctggaaacagatacaaagagtggagacttgggccctgagacacccaggattcacgatgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcttactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcttttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacgccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaatgagagtgatcccgaaggggcactctggtga

SEQ ID NO: 112 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacctccaacagcaggaattttggctagatggagctcattcaagaagaatggagcgatcaaagtgttacggggtttcaaaaaagagatctcaagcatgttgaacataatgaacaggaggaaaagatccgtgactatgctcctcatgctgctgcctactgccctggcgttccacttgaccacacgagggggagagccacacatgatagttagtaagcaggaaagaggaaagtcactcttgttcaagacctctgtaggtgtcaatatgtgcactctcattgcgatggatttgggagagttgtgtgaggacacaatgacctacaaatgcccccggatcactgaggcagaaccagatgatgttgactgttggtgcaatgccacagacacatgggtgacctatgggacgtgttctcaaaccggcgaacaccgacgagacaaacgttccgtcgcactggccccacacgtgggacttggtctagaaacaagaaccgagacgtggatgtcctctgaaggtgcctggaaacaaatacaaagagtggagacttgggccttgcgacacccaggattcacggtgatagcccttttcttggcacatgccataggaacatccatcactcagaaagggatcattttcattttgctgatgctggtaacaccatcaatggccatgcgatgcgtgggaataggcaacagagacttcgttgaaggactgtcaggagcaacgtgggtggacgtggtactggagcatggaagctgcgtcaccaccatggcaaaaaataaaccaacattggacattgaactcttgaaaacggaggtcacgaaccctgccgtcctgcgcaaactgtgcattgaagctaaaatatcaaacaccaccaccgattcaagatgtccaacacaaggagaagctacactggtggaagaacaagacgcgaactttgtgtgtcgacgaacgctcgtggacagaggctggggcaatggctgcggactatttggaaaaggaagcctactgacgtgtgctaagttcaagtgtgtgacaaaattagaaggaaaggtagtacaatatgaaaacttaaaatattcagtgatagtcactgtccacactggggaccagcatcaggtgggaaacgagaccacagaacatggaacaattgcaaccataacacctcaagctcctacgtcggaaatacagctgaccgactacggagccctcacattggactgctcacctagaactgggctggactttaatgagatggtgctattgacaatgaaagaaaaatcatggcttgtccacaaacaatggtttctagatttaccactgccttggacttcgggggcttcaacatcccaagagacctggaacagacaggacttgctggtcacattcaagacagctcatgcaaagaagcaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtgatgtgcacaggctcatttaagttagagaaggaagtggctgagacccagcatggaactgttttagtgcaggttaaatacgaaggaacagatgcaccatgcaagatccccttttcgatccaagatgagaaaggagtgacccagaatgggagattgataacagccaatcctatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgctcgaggagcacgaaggatggctatcctgggagacaccgcatgggacttcggttctataggaggagtgtttacgtctgtgggaaaactgatacatcaggtttttggaaccgcatatggggttctgttcagcggtgtttcttggaccatgaaaataggaatagggattctgctgacatggttgggattaaattcaaggagcacgtcattttcgatgacgtgcattacagttggcatggtcacactgtacctaggagtcatggttcaagcggattcgggatgtgtaatcaactggaagggcagagaactcaaatgtggaagtggcatttttgtcactaatgaagtccacacctggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaactacatcttacttgaaaatgacataaaattcacagtggttgtaggagatgctaatggaattttggcccaaggaagaaaaatgattagaccacaacccatggaacacaaatactcatggaaaagctggggaaaagccaaaatcataggagcagacatacagaacaccaccttcatcattgacggcccagatactccagaatgtcccgatgaccagagagcatggaacatctgggaagttgaggactatggattcggaattttcacgacaaacatatggctgaaattgcgtgactcctacacccaaatgtgtgaccaccggctaatgtcagctgccatcaaggacagcaaggcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatgataattccaaagatatatggaggaccaatatctcagcacaactacagaccagggtatttcacacaaacagcagggccatggcacctaggcaagttggaattggattttgatttgtgtgagggtaccacagtcgttgttgatgaacattgtggaaatcgaggtccatctctcagaactacaacagttacaggaaagataatccatgaatggtgttgcagatcctgcacgttaccccccttacgcttcagaggagaagacggatgttggtatggtatggaaatcagaccagttaaggagaaggaggagaacctagttaggtcaatggtctctgcagggtcaggagaagtagacagtttttctttaggaatactatgcgtatcaatactgattgaagaagtgatgagatccagatggagtagaaagatgctgatgactggaacactggctgttttcctccttcttataatgggacaactgacatggaatgatctgatcaggttatgcatcatggttggagccaacgcttcagacaggatggggatgggaacaacgtacctagccttgatggctactttcaaaatgagaccaatgctcgctgttgggctattatttcgtagactaacatccagagaagttcttcttctcacgattggactaagcctggtggcatccgtggagctaccaaattctttagaggagctaggggatggactcgcaatgggcatcatgatgttaaaattattgactgattttcagccacaccagttatggaccaccttactgtctttaacatttatcaaaacgactctttcattggattatgcatggaagacaatggctatggcattgtcaatcgtatctctctttcctttgtgtttgtctacgacctcccaaaaaacaacatggcttccggtgctgctaggatcttttggatgtaaaccattaaccatgtttcttataacagaaaacaaaatctggggaagaaaaagttggcccatcaatgaaggaattatggctgttggaatagtcagcattctactaagttcactcctcaaaaatgatgtgccgctagccggcccactaatagctggaggcatgctaatagcatgttatgtcatatccggaagctcagccgatttatcattggagaaagcggctgaggtatcctgggaagaagaagcagaacactctggcacctcacacaacatattagtggaggtccaagatgatggtaccatgaaaataaaagatgaagagagggatgacacactcaccatactccttaaagcaactctgctggcagtctcgggagtgtacccaatgtcaataccagcaactctttttgtgtggtatttttggcagaaaaagaaacagagatcaggagtgttatgggacacacccagccctccggaagtggaaagagcagttcttgatgatggcatttatagaatcttgcaaagaggactgttgggcaggtcccaagtaggggtgggagttttccaagacggcgtgttccacacaatgtggcacgtcaccaggggagctgtccttatgtaccaagggaagaggctggaaccaagctgggccagtgtcaaaaaagacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaaaatagtaggtctttatggaaatggagtggtgacaacaagtggaacctacgtcagtgccatcgctcaagccaaagcatcacaagaagggcctctaccagagattgaggacgaggtgtttaagaaaagaaacttaacaataatggacttgcatccaggatcaggaaaaacaagaagatatcttccagccatagtccgtgaggccataaaaaggaagctgcgcacgctaatcttggctcccacaagagttgtcgcctctgaaatggcagaggcgctcaagggaatgccaataagatatcagacaacagcagtgaagagtgaacacacaggaagggagatagttgacctcatgtgccacgccacctttactatgcgtctcttatctccagtgagagttcccaattacaacatgattatcatggatgaagcacattttaccgatccagccagcatagcggccagagggtacatctcaacccgagtgggtatgggtgaagcagctgcgatcttcatgacagccactcccccaggatcggtggaggcctttccacagagtaatgcagttatccaagatgaggaaaaagacattcctgagagatcatggaactcaggctacgactggatcactgattttccaggtaaaacagtttggtttgttccaagcatcaaatcaggaaatgacatcgccaactgtttaagaaagaacggaaaacgggtgattcaactgagcaggaaaacttttgacactgagtaccagaaaacaaaaaataatgactgggactatgttgtcacaacagacatttctgaaatgggagcaaatttccgggccgacagggtaatagatccaaggcggtgcttgaaaccggtaatactaaaagatggtccagagcgcgtcattctagccggaccaatgccagtgactgtggccagtgctgcccagaggagaggaagaattggaaggaaccaaaacaaagaaggtgatcagtacgtttacatgggacagcctttaaataatgatgaggaccacgctcattggacagaagcaaaaatgctccttgacaatataaacacaccagaagggatcatcccagccctctttgagccagagagagaaaagagtgcagcaatagacggggagtacagactgcggggagaagcaagaaaaacgttcgtggagctcatgagaagaggagatctaccagtttggttatcctacaaagttgcctcagaaggtttccaatattccgacagaagatggtgctttgatggggaaaggaacaaccaggtgttggaggagaacatggacgtggagatctggacaaaggaaggagaaagaaagaaattgcgaccccgctggttggatgctagaacttactctgatccactggccctgcgcgagtttaaagagtttgcagcaggaagaagaagtgtctcaggtgacctaatattggaaataggaaaacttccacaacatttgacgctgagagcccagaatgctttggataacttggtcatgttgcacaattccgaacaaggagggaaagcctacagacatgctatggaggaactaccagacaccatagaaacattgatgctcctagctttgatagctgtgctcactggtggagtgacgctgttcttcctatcaggaaaaggtctggggaaaacatccattggcctactctgtgtgatggcctcaagcgcactgttatggatggccagtgtggagccccattggatagcggcctccatcatactagagttctttctgatggtgctgctcattccagagccagacagacagcgcactccacaggacaaccagttagcatacgtggtgataggtttgttattcatgatacttacagtggcagccaatgagatgggattactggaaaccacaaagaaagacctggggattggccatgtagctgccgaaaaccaccaccatgctacaatgctggacgtagacctacgtccagcttcagcctggaccctctacgcagtagccacaacagttatcacccccatgatgagacacacaattgaaaatacaacggcaaatatttccctgacagccattgcaaatcaggcagccatactgatgggacttgacaagggatggcctatatcgaagatggacataggagttccacttctcgccctagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctgggtcaaataatgttactgatactttgtacatcacagattctcttgatgcggaccacatgggccttgtgtgaatccatcacactggctactggacccttaaccactctctgggagggatctccaggaaaattctggaataccacgatagcagtgtccatggcaaacatcttcaggggaagttatctagcaggagcaggtctggccttctcattgatgaaatctttaggaggaggtaggagaggtacgggagctcaaggagaaacactgggagaaaaatggaaaagacagctaaaccaactgagcaagtcagaatttgacacctacaaaaggagtgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgcgctgggctgaagaaagtcactgaagtgaagggatatacaaaaggaggacctggacatgaggaacctatcccaatggcgacctatggatggaacctagtaaagctacactctggaaaagatgtattcttcataccgcctgagaaatgtgacacccttttgtgtgacatcggtgagtcctctccgaatccaactatagaagaaggaagaacgttacgtgttctaaagatggtggaaccatggctcagaggaaaccaattctgcataaaaatcttaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatctagaatgttactgaaccgattcacaatggctcacaggaagccaacatatgaaagagatgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcttatcatggatcatatgaggtcaagccatcaggatcagcctcatccatggtgaatggcgtggtgagattgctcaccaaaccatgggatgttatccccatggtcacacaaatagccatgactgataccacaccattcggacaacagagggtgtttaaagagaaagttgacacacgcactccaagagcaaaacgaggcacagcacaaattatggaggtgacagccaagtggttatggggtttcctttccagaaacaaaaaacccagaatctgcacaagagaggagttcacaagaaaagttaggtcaaatgcagcaataggagctgtgttcgttgatgaaaaccaatggaactcagcaaaagaagcagtggaagacgaaaggttttgggatctcgtgcacagagagagagagcttcataaacagggaaaatgtgccacgtgtgtttacaacatgatggggaagagagagaaaaaattaggagagtttggaaaagcaaaaggaagccgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacatcaatttttaaactgacctaccaaaataaggtggtgagggtgcaaagaccagcaaaaagtggaaccgtgatggatgtcatatccagacgtgaccagagaggaagtggacaggtcggaacttatggcttaaatactttcaccaatatggaagtccaactaataagacaaatggagtctgaaggaatctttttacctagcgaattggaaacccccaatctagctaagagagttcttgactggttggaaaaacatggcgctgaaaggctgaaaagaatggcaattagcggagatgattgtgtggtgaaaccaattgacgacaggttcgcaacagccttaacagctctgaatgatatgggaaaagtaagaaaagacataccgcagtgggaaccttcaaaaggatggaatgactggcagcaagtgcctttctgttcacaccacttccaccagctgatcatgaaagatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtggccataaaccaggtgagaaggctcatcgggaatgagaattatctagattacatgacatcaatgaagagatttaagaatgagagtgatcctgaaggggcgctctggtaa

SEQ ID NO: 113 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggttttaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgactgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacctggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacgctatacttaggagttatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacgtgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactcctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggccactttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgatacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcagctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggccttctctgcgtgatggcttcaagcgtactgctatggatggccagtgtagagccccattggatagcggcctccatcatactggagttcttcctgatggtgctgcttattccagagccagacagacaacgcactccgcaggataaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatccctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccagtcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgattccgaaggggcactctggtga

SEQ ID NO: 114 - DNA, 10179 bp, Dengue virus
atgaacaaccaacgaaaaaagacggctcgaccgtctttcaatatgctgaaacgcgcgagaaaccgcgtgtcaactgcttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttattaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagttcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaacttaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccccgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaaaaagaagcagaacactctggtgcctcacacaacatattagtggaggtccaagatgatggaaccatgaagataaaggatgaagagagagatgacacgctaactattctccttaaagcaactctgctagcagtttcaggggtgtacccattatcaataccagcgaccctttttgtgtggtacttttggcaaaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgttaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatattaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcggtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactactggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcatacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggacgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaatcaagtgagaagactaattgggaatgagaattatctagattacatgacatcaatgaagagattcaagaacgagagtgatcccgaaggggcactctggtga

SEQ ID NO: 115 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcatcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttccggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcacatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacataacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 116 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatgtcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacactggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaaggggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 117 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagttcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccaacatggaaccgttctagtgcagattaaatacgaaggaacagatgcaccatgcaagatccctttttcgacccaagatgaaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattgaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacatacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcttgggaagaagaagcagaacactctggtgcctcacacaacatattagtggaggtccaagatgatggaaccatgaagataaaggatgaagagagagatgacacgctaactattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcggtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaacaacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggcccacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgatactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 118 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaattgcaactataacacctcaagctcctacgacagaaatacagctgaccgactacggagttcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccaacatggaaccgttctagtgcagattaaatacgaaggaacagatgcaccatgcaagatccctttttcgacccaagatgaaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattgaactcaaggagcacgtccctttcgatgacgtgcattgcagttggcctagtaacgctatacttaggagtcatggttcaggcggattcagggtgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtactacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaacgatctgatcagactatgcatcatggttggagccaacgcttccgacaggatggggatgggaacgacatacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcttgggaagaagaagcagaacactctggtgcctcacacaacatattagtggaggtccaagatgatggaaccatgaagataaaggatgaagagagagatgacacgctaactattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaggacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcggtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctaacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggcccacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgatactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 119 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcttaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagagcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgctattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaaactaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcttaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 120 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctgggagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggcaggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacgcgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 121 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagttcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccaacatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacatacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcttgggaagaagaagcagaacactctggtgcctcacacaacatattagtggaggtccaagatgatggaaccatgaagataaaggatgaagagagagatgacacgctaactattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaactgcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcggtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaagttactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 122 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccttttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcgtatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaataccaataaggtaccaaacaacagcagtgaagagtgaacacacaggaaaagagatagttgacctcatgtgtcacgccactttcaccatgcgccttctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgatagatttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 123 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaagcatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtcctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaaccataacacctcaagctcctacgacagaaatacagctgagcgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacggctcatgcaaagaagcaggaagtagtcgtactaggatcacaagaaggagcaatgcacactgcgttgaccggagcgacggagatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccattgggaaggcatgggaggagggtgtgtgtggaattcgatcagcaactcgtctcgaaaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaaccgaggaccatctcttaggaccacaacagtcacaggaaagataattcatgaatggtgttgcagatcttgtacgctaccacctttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgccgtagggctactattccgcagactaacatccagagaagttcttcttctaacaattggattgagtctagtgacatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtactgttgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgtcatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgttagcagtttcaggggtgtacccattatcaataccagcgaccctttttgtgtggtacttttggcagaaaaagaaacagagatctggagtgttatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctgcatccaggatcgggaaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggagctcaggttatgagtggatcactgacttctcaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctatatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcatccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccacaatgctggatgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggcccattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatccttttgatgcggactacatgggccttgtgcgaatccatcacactggccactggacctctgaccacgctctgggagggatctccaggaaaattttggaacaccacgatagcagtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccagctgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgcattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcataggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagaaagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccatttccaccagctgatcatgaaggatgggagggaaatagtggtgccatgccgcaaccaagatgaacttgtgggtagggctagagtatcacaaggtgctggatggagcctgagagaaaccgcatgcctaggcaaatcatatgcacaaatgtggcagctgatgtacttccacaggagagacctgagactagctgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 124 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcattggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcatcaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacaacacaagaaacttggaacagacaagatttgctggtgacatttaagacagctcatgcaaagaagcaggaagtagtcgtactaggatcacaagaaggagcaatgcacactgcgctgaccggagcgacggaaatccaaacatctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggcttagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgatggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacggttgttgtggatgaacattgtggaaatcgaggaccatctcttaggaccacaacagtcacaggaaagataatccatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaagtgacatggaatgatctgatcagattatgcatcatggttggagccaacgcttccgacaggatggggatgggaacgacgtacctagctctgatggccacttttaaaatgagaccaatgcttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaattgtcagcatcctactaagttcactcctcaaaaatgatgtgccgctagctggaccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttgtgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagccccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagatgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgttgcacaattccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaggacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgactgccattgcaaaccaggcagctatcttgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcgaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatccttttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattgatgaaatccctaggaggaggtaggagaggcacgggagcccaaggggaaacactgggagagaaatggaaaagacagctgaaccaactgaccaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcggctggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccgcaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaaccgcatgcctaggcaaatcatatgcacaaatgtggcagctgatgtacttccacaggagagacctgagactagctgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 125 - DNA, 10179 bp, Dengue virus
atgaacaaccaacgaaaaaagacggctcgaccgtctttcaatatgctgaaacgcgcgagaaaccgcgtgtcaactgcttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacctgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagttcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaacttaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccctttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaaaaagaagcagaacactctggtgcctcacacaacatattagtggaggtccaagatgatggaaccatgaagataaaggatgaagagagagatgacacgctaactattctccttaaagcaactctgctagcagtttcaggggtgtacccattatcaataccagcgaccctttttgtgtggtacttttggcaaaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgttaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcggtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactactggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcatacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacttggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 126 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccttttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgtgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 127 - DNA, 10179 bp, Dengue virus
atgaacaacccacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccttttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggcaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctaagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 128 - DNA, 543 bp, Dengue virus
atgaacaaccaacggaagaagacgggtcgaccgtctttcaatatgctgaaacgcgcgagaaaccgcgtgtcaactggttcacagttggcgaagagattctcaaaaggattgctctcaggccaaggacccatgaaaatggtgatggctttcatagcattcctaagatttctagccatacccccaacagcaggaattttggctagatggagctcattcaaaaagaatggagcgatcaaagtgttacggggtttcaaaaaagagatctcaagcatgttgaacataatgaacaggagaaaaagatccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacttacaaacagatgatgttgattgctggtgcaatgctacagacacatgggtga

SEQ ID NO: 129 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcagaggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgtacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 130 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgtaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctgggagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggagggatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacgcgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgaggggatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 131 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgctgaatataatgaatagaaggaaaagatctgtgaccatgctccttatgctgatgcctacagccttggcgttccatttgaccacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccttttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcaggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaggatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtagaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 132 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcctggaaacagatacaaagagtggagacttgggccctgagacacccaggattcacggtgatagccttttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggttgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatggccatgactgacactacaccctttggacaacagagggtgtttaaagagaaagttgacacacgcacgccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 133 - DNA, 10179 bp, Dengue virus; identical to SEQ ID NO: 127

SEQ ID NO: 134 - DNA, 10179 bp, Dengue virus; identical to SEQ ID NO: 104

SEQ ID NO: 135 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccttttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcctagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 136 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccttttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctctttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagagcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 137 - DNA, 9990 bp, Dengue virus
  misc_feature (8290)..(8290): n is a, c, g, or t
atgaacaaccaacggaaaaagacgggtcgaccgtctttcaatatgctgaaacgcgcgagaaaccgcgtgtcaactgtttcacagttggcgaagagattctcaaaaggattgctttcaggccaaggacccatgaaattgatgatggcttttatagcattcctaagatttctagccatacccccaacagcaggaattttggctagatggagctcattcaagaagaatggagcgatcaaagtgttacggggtttcaagaaagagatctcaaacatgttgaacataatgaacaggaggaaaagatctgtgaccatgctcctcatgctgctgcccacagccttggcgttccatctgaccacccgaggaggagagccgcacatgatagtcagcaagcaagaaagaggaaaatcacttttgtttaagacctctgcaggtgtcaacatgtgtacccttattgcaatggatttgggagagttatgtgaagacacgatgacttacaaatgccctcggatcactgagacggaaccagatgacgttgactgttggtgcaatgccacggagacatgggtgacctatggaacatgttcccaagctggtgaacaccgacgagacaaacgttccgtcgcattggcaccacacgtagggcttggtctagaaacaagaaccgaaacgtggatgtcctctgaaggcgcttggagacaaatacaaaaagtggagacttgggctctaagacacccaggattcacggtgatagccctttttctagcacatgctataggaacatccatcacccagaaagggattatttttattttgctgatgctggtaactccatccatggccatgcggtgcgtgggaataggcaacagagacttcgtggaaggactctcaggagctacgtgggtggatgtggtgctggagcatggaagttgcgtcactaccatggcaaaagacaaaccaacactggacattgaactcctgaagacggaggtcacaaaccctgcagtcctgcgcaaattgtgcattgaagctaaaatatcaaacaccaccaccgattcgagatgtccaacacaaggagaagccacgctggtggaagagcaggacacgaactttgtgtgccgacgaacgttcgtggacagaggctggggcaatggttgtgggctattcggaaaaggtagcttaataacgtgtgctaagtttaagtgtgtgacaaaactggaaggaaacatagtccaatatgaaaacttaaaatattcagtcatagtcaccgtacacactggagaccaacaccaagttggaaatgagaccacagaacatggaacaactgcaaccataacacctcaagctcccacgtcggaaatacagctgacagactacggagctctaacattggactgctcacctagaactgggctggactttaatgagatggtgctgttgacaatgaaagaaaaatcatggcttgtccacaaacaatggtttctagacttaccactgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgcagactaaaaatggataaactgaccttaaaaggggtgtcatatgtaatgtgcacagggtcattcaagctagagaaggaagtggctgagactcagcatggaactgttctagtgcaggtcaaatacgaaggaacagatgcaccatgcaagatccccttttcgaccaaagatgagaagggagtgacccagaatagattgataacagccaaccccatagtcattgacaaagaaaaaccagttaacattgaagcggagccaccttttggtgagagctaccttgtggtaggagcaggtgaaaaagctttgaaactaagctggttcaagaagggaagcagtataggaaagatgtttgaagcaactgctcgtggagcacgaaggatggccatcctgggagacaccgcatgggacttcggttctataggaggggtgtttacgtctgtgggaaaattgatacaccagatttttgggactgcgtatggagttttgttcagcggggtttcttggactatgaaaataggaatagggattctgctgacatggctaggattaaattcaaggagcacgtccctttcaatgacgtgtatcgcagttggcatggtcacactgtacctaggagtcatggttcaggcggactcgggatgtgtaatcaactggaaaggcagagaactcaaatgtggaagcggcatttttgtcaccaatgaagtccacacctggacagagcaatacaaattccaagctgactcccccaagagactatcagcagccattgggaaggcatgggaggagggtgtgtgtggaatccgatcagccactcgcctcgagaacattatgtggaagcaaatatcaaatgaactaaaccacatcttacttgaaaatgacatgaaatttacagtggtcgtaggagaagttaatggaatcttagcccaaggaaagaaaatgattaggccacaacccatggaacacaaatattcgtggaaaagctggggaaaagccaaagtcataggagcagatgtacagaataccaccttcatcatcgacggcccaaacaccccagaatgccctgataatcagagagcatggaacatttgggaagtcgaagactatggatttggaattttcacgacaaacatatggttgaaactgcgtgactcctacactcaagtgtgtgaccaccggctaatgtcagctgccatcaaggatagcagagcagtccatgctgacatggggtactggatagaaagtgaaaagaacgagacttggaagttggcaagagcctccttcatagaagttaagacatgcatctggccaaaatcccataccctatggagcaatggagtcctggaaagtgagatgataatcccaaaaatatatggaggaccaatatctcagcacaactacagaccaggatatttcacacaaacagcagggccgtggcacttgggcaagttagaactggattttggtttatgtgaaggtaccaccgttgttgtggatgaacattgtggaaatcgaggaccatctcttagaaccacaacagtcacaggaaagataatccatgaatggtgctgcagatcttgcacgttaccccccctacgtttcaaaggagaagacgggtgctggtacggtatggaaatcagaccagtcaaggagaaggaagagaacctagtcaaatcaatggtctctgcagggtcaggagaagtggacagtttttcactaggactgctatgcatatcaataatgatcgaagaggtaatgagatccagatggagtagaaaaatgctgatgactggaacattggctgtgttcctccttcttacaatgggacaattgacatggaatgatctgatcaggctatgtatcatggttggagccaatgcttcagacaagatggggatgggaacaacgtacctagctttgatggccactttcagaatgagaccaatgttcgcagtcgggctgttgttccccagactaacgtctagagaagttcttcttctcacagttggattgagtctagtggcatctgtagaactaccaaattccttggaggagctaggggatggacttgcaatgggcatcatgatgttgaaattactaactgattttcagtcacaccagctatgggctgccttgctgtctctaacatttgtcaaaacaactttatcattgcactacgcatggaagacaatggctatgatactgtcaattgtatctctcttccctctatgcctgtccacgacttctcaaaaaacaacatggctcccggtgttgctgggatctcttggatgcaaaccactaaccatgtttcttataacagaaaacaaaatctggggaaggaaaagttggcctctcaatgagggaattatggctgttggaatagttagtattcttctaagttcactcctcaaaaatgatgtgccgctagctggcccactaatagctggaggcatgctaatagcatgttatgttatatctggaagctcggccgatttatcattggagaaagcggctgaggtctcctgggaagaagaagcagaacactctggtgcctcacacaacatactagtggaggtccaagatgatggaaccatgaagataaaggatgaagagagggatgacacacttaccattctcctcaaagcaactttgctagcaatctcaggggtgtacccaatgtcaataccggcgaccctctttgtgtggtacttttggcagaaaaagaaacagagatcaggagtgctatgggacacacccagccctccagaagtggaaaaagcagtccttgatgatggcatttatagaattctccaaagaggactgttgggcaagtctcaagtaggagtgggagtttttcaagaaggtgtgtttcacacaatgtggcacgtcaccaggggagctgtcctcatgtatcaagggaagagattggaaccaagttgggctagtgtcaaaaaagacttgatctcatatggaggaggttggaggtttcaaggatcctggaacacgggagaagaagtgcaggtgattgctgttgaaccggggaagaaccctaaaaacgtacagacagcgccgggtacctttaagacttctgaaggcgaagttggagctatagctctagactttaaacccggcacatctggatctcctattgtgaacagggagggaaaaatagtaggtctttatggaaatggagtggtgacaacaagtggaacctacgtcagtgccatagcccaagccaaacattcacaagaaggacctctaccagagattgaggacgaggtgtttaggaaaagaaacttaacaataatggacttacatccaggatcgggaaaaacaagaagataccttccagccatagtccgtgaggctataaaaagaaagttacgcacgctagtcttagctcccacaagagttgtcgcctctgaaatggcagaggcgctcaagggaatgccaataaggtaccagacaacagcagtgaaaagtgaacacacgggaaaggagatagttgaccttatgtgtcatgccacttttaccatgcgtctcctttcccctgtgagagttcccaattataatatgattatcatggatgaagcacatttcactgatccagccagcatagcagccagagggtacatctcaacccgagtgggtatgggtgaagcagctgcaattttcatgacagccactccccccggatcgatggaggcctttccacagagcaatgcagctatccaagatgaggaaagagacattcctgaaaggtcatggaactcaggttatgactggatcaccgatttcccaggtaaaacagtttggtttgttccaagcatcaaatcaggaaatgacattgccaactgtttaagaaagaatgggaaacgggtgatccaattgagcagaaaaaccttcgacactgagtaccagaagacaaaaaataacgactgggactatgttgttacaacagacatatccgaaatgggagcaaacttccgagcagacagggtaatagacccgaggcggtgcctgaaaccagtaatactaaaagatggcccagagcgtgtcattctagccggaccgatgccagtgactgtggctagcgccgcccagaggagaggaagaattggaaggaaccaaaataaggaaggtgatcagtatatttacatgggacagcctctaaacaatgatgaggaccacgcccattggacagaagcaaaaatgctccttgacaacataaacacaccagaagggattatcccagccctctttgagccggagagagaaaagagtgcagcaatagacggggaatacagactacggggtgaagcgaggaaaactttcgtggagcttatgagaagaggagatctacctgtctggctatcccacaaagttgcctcagaaggcttccagtactccgacagaaggtggtgctttgatggagaaaggaacaaccaggtgctggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaatgccttggacaatctggttatgctgcataactctgaacagggaggaaaagcctacagacacgccatggaagaactaccagacaccatagaaacattaatgcttctggctttgatagctgtgctgactggtggggtgacgctgttcttcctatcaggaaggggtctaggaaaaacatccattggcctactctgcgtgatggcctcaagtgcactgttatggatggccagtgtggaaccccattggatagcggcctctatcatactggagttctttctgatggtgctgcttattccagaaccggacagacagcgcactccacaagacaaccagctagcatacgtggtgataggtctactattcatgatattgacagtggcagccaatgagatgggattactggaaaccacaaagaaggacctagggattggtcatgcagctgctgaaaaccaccatcatgctgcaatgctggacgtagacctacatccagcttcagcctggaccctctatgcagtggccacaacaattattactcccatgatgagacacacaattgaaaacacaacggcaaacatttccctgacagctatcgcaaaccaggcagctatattgatgggacttgacaagggatggccaatatcaaagatggacataggagttccacttctcgccttggggtgctattctcaggtgaacccactgacgctgacagcggcggtattgatgttagtggctcattacgccctaattggacccggactgcaagcaaaagctactagagaagctcaaaaaaggacagcagctggaataatgaaaaacccaactgttgatgggatcgtcgcaatagatttggaccctgtggtttacgacgcaaaatttgaaaaacagctaggccaaataatgctgttaatactttgcacatcacagatcctcctgatgcggaccacatgggccttgtgtgaatccatcacactagccactggacctctgaccacactctgggagggatctccaggaaaattctggaacaccacgatagcggtgtccatggcaaacatttttaggggaagttatctagcaggagcaggtctggccttttcattaatgaaatctctaggaggaggtaggagaggcacgggagcccaaggggaaacactgggagaaaaatggaaaagacagctaaaccaattgagcaagtcagaattcaacacttacaaaaggagtgggatcatggaggtggacagatctgaagccaaagaggggttgaaaagaggagaaacgactaaacacgcggtgtcgagaggaacggccaaactgaggtggtttgtggagaggaaccttgtgaaaccagaggggaaagtcatagacctcggttgtggaagaggtggctggtcatactattgcgctgggctgaagaaagtcacagaagtgaaaggatacacgaaaggaggacctgggcatgaagaaccaattccaatggcaacctatggatggaacctagtaaagctacactccgggaaagatgtattctttacaccacctgagaaatgtgacactctcttgtgtgatattggtgagtcctctccgaacccaaccatagaagaaggaagaacattacgtgttctaaggatggtggaaccatggctcagaggaaaccaattctgcataaaagttctaaatccctatatgccgagtgtggtagaaactttggagcagatgcaaagaaaacatggaggaatgctagtgcgaaatccactctcaagaaactccactcatgaaatgtactgggtttcatgtggaacaggaaatattgtgtcagcagtaaacatgacatctagaatgctgctaaatcgattcacaatggctcacaggaagccaacatatgaaagagacgtggacttaggcgctggaacaagacatgtggcagtggaaccagaggtagccnacctagatatcattggccagaggatagagaatataaaaaatgaacaccaatcaacatggcattatgatgaggataatccatacaaaacatgggcctatcatggatcatatgaggtcaagccatcaggatcagcctcatccatggtcaatggtgtagtgagactgctaaccaaaccatgggatgtcatccccatggtcacacaaatagccatgactgacactacaccctttggacaacagagggtgttcaaagagaaagttgacacgcgcacaccaaaagcgaaacgaggcacagcacaaattatggaggtgacagctaggtggttatggggttttctctctagaaacaaaaaacctagaatctgcacaagagaggagttcacaagaaaagtcaggtcaaacgcagctatcggagcagtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaactaggagagttcggaaaggcaaaaggaagccgcgcaatatggtacatgtggttgggagcgcgctttttagagtttgaagcccttggtttcatgaatgaagatcactggttcagcagagagaattcactcagtggagtggagggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgctctattggccacgtcaatctttaagctaacctaccaaaataaggtagtaagggtgcagagaccagcgaaaaatggaaccgtgatggatgtcatatccagacgtgaccagagaggaagtggacaggttggaacctatggcttaaacaccttcaccaacatggaggcccaactaataagacaaatggagtctgagggaatctttacacccagcgaattggaaaccccaaatctagccgaaagagttctcgactggttggaaaaacatggcatcgagaggctgaaaagaatggcaatcagtggagatgactgtgtggtgaaaccaattgatgacaggttcgcaacagccttaacagctttgaatgacatgggaaaggtaagaaaagacataccgcaatgggaaccctcaaaaggatggaatgattggcaacaagtgcctttctgttcacaccatttccaccaactgattatgaaggatgggagggagatagtggtgccatgccgcaaccaagatgaacttgtgggtagggccagagtatcacaaggcgctggatggagcctgagagaaactgcatgcctaggcaaatcatatgcacaaatgtggcagctgatgtacttccataggagagacttgagattagcagctaatgctatctgttcagccgttccagttgattgggtcccaaccagccgcaccacctggtcgatccatgcccaccaccaatggatgacaacagaagacatgttatcagtgtggaatagggtttggatagaggaaacccatggatggaggacaaaactcacgtgtcccgttgggaagacgttccatacctag

SEQ ID NO: 138 - DNA, 10179 bp, Dengue virus
atgaacaaccaacgaaaaaagacggctcgaccgtctttcaatatgctgaaacgcgcgagaaaccgcgtgtcaactgcttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagttcttacattggattgttcacctagaacaggactagactttaatgaaatggtgttgttgacaatgaaagaaaaatcatggctagtccacaaacaatggtttctagacctaccactgccttggacctcgggagtttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaacttaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaaaaagaagcagaacactctggtgcctcacacaacatattagtggaggtccaagatgatggaaccatgaagataaaggatgaagagagagatgacacgctaactattctccttaaagcaactctgctagcagtttcaggggtgtacccattatcaataccagcgaccctttttgtgtggtacttttggcaaaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgttaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcggtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactactggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcatacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtgggacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 139 - DNA, 10179 bp, Dengue virus; identical to SEQ ID NO: 87

SEQ ID NO: 140 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggttttaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcatatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaaaacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacgctatacttaggagttatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacgtgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactcctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggccaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactccttaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgatacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcagctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggccttctctgcgtgatggcttcaagcgtactgctatggatggccagtgtagagccccattggatagcggcctccatcatactggagttcttcctgatggtgctgcttattccagagccagacagacaacgcactccgcaggataaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaactttgtgaaaccagaagggaaagtcatagacctcggttgtggaagaggtggctggtcatactattgcgctgggctgaagaaagtcacagaagtgaagggatacacaaaaggaggacctggacatgaagaaccagtcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgattccgaaggggcactctggtga

SEQ ID NO: 141 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 142 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagcccatgcgaagaagcaggaagtagtcgtattaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggtgacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaataaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaagaaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggtacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagaccactggttcagcagagagaattcactcagcggagtggaaggagaaggactccacaaacttggatatatacttagagacatatcaaagattccagggggaaacatgtatgcagatgacacagccggatgggatacaaggataacagaggatgatcttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaactgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 143 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcgggccaaggacccgtgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggagaaaatctgtgaccatgctccttacgctgatgcctacagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacagtgacttacaaatgccctcgaatcactgaggcggaaccagatgacgttgattgttggtgcaatgccacagacacatgggtgacctatggaacatgttcccaaactggcgagcaccgacgagacatacgttccgtcgcactggccccacacgtgggacttggtttggaaacaagaactgaaacgtggatgtcctctgaaggcgcttggaaacagatacaaagagtggatacttgtgtcctgagacacccaggattcacggtgatagccctttttctagcacatgccataggaacatccatcagccagaaagggattattttcattttgttaatgctggtaacaccatccatgaccatgcgatgcgtgggaataggcagcagggacttcgtggaaggactgtcaggagcaacttgggtagatgtggtactggaacatggaagttgtgtcaccagcatggcaaaagacaaaccaacactggacattgaactgttgaagacggaagtcccaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgataagttcaagtgtgtgacaaaactggaaggaaagataattcaatatgaaaactttaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggattagactttaatgaaatggtgttgttgacaatgaaagaaaaatcatggctagtccacaaacaatggtttctagacttaccactgccttggacctcgggagcttcaacatcacgagagacctggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatggaagattgataacagccaaccccatagtcactgacaaagaaaaaccagtcaacattgaggcagaaccgccttttggtgagagttacatcgtgataggagtaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggttaggattaaactcaaggagcacgtccctctcgatgacgtgcattgcagttggcctagtaacactatacctaggagtcatggttcaggcggattcaggatgcgtaattaattggaagggtagaggactcaaatgtggaagtggcatttttgtcaccaatgaagttcacacttggacagggcaatacaaatttcaagctgactccccaaaaggactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaaaaaaatgattaggccacaacccatggaacacaaatactcgtggaaaaattggggaaaggctaaaatcataggggcagatgtacagaactccaccttcatcattgacggcccaaacaccccagaatgctctgatgaccaaagagcatggaacatttgggaagttgaggactatggatttggaattttcacgacaaacatatggctgaaattgcgtgactcctacacccaagtgtgtgaccaccggctaatgtcagcagccatcaaggacagcaaggcagttcacgctgacatggggtactggatagaaagtgaaaagaacgagacctggaagctggcaagagcctctttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaattggattttgatttgtgtgagggtaccacagtcgttgtggatgaacattgtggaaatcgaggaccatctcttgggaccacaacagtcacaggaaagataattcatgaatggtgttgcagatcttgtacgctaccacccttacgtttcagaggagaagatgggtgctggtacggtatggaaatcagacccgtcaaggaaaaggaagagaatctagtcaaatcaatggtctctgcagggtcaggggaagtggacagcttttcactgggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaaccattggattgagtctagtggcatctgtggagttaccaaattccttggaggagctgggggatggacttgcaatgggcattatgattttaaaattattgactgactttcgatcacatcagttgtgggctaccttgctgtccatgacatttatcaaaacagcgttttccttgcactatgcatggaagacaatggctatggtactgtcaattgtatctctcttccccttatgcctgtacacgacctcccagaaaacaacatggcttccggtgctattgggatctcttggatgcaaaccactaaccatgttccttatagcagaaaacaaaatctggggaaggaaaagctggcccctcaatgaagggatcatggctgttggaatagtcagcatcctactaagttcactcctcaaaaatgatgtgccgctagctgggccactaatagctggaggtatgctaatagcatgttatgttatatctggaagctcagccgacctatcactagagaaagcagctgaggtctcctgggaagaagaagcagaacactctggtgcctcacacaacatattagtggaggttcaagacgatggaaccatgaagataaaggatgaagagagagatgacacgctaaccattctccttaaagcaactctgctagcagtttcaggggtgtacccattatcaataccagcgaccctttttgtgtggtgcttttggcagaaaaagaaacagagatctggagtgttatgggacacacctagccctccaaaagtggaaagagcagttcttgatgatggtatctatagaattatgcagagaggactgttgggcaggtcccaagtaggggtaggagtttttcaagaaaacgtgttccatacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacggcgccgggcacctttaagacccctgaaggtgaagttggagccattgccctagattttaaacccggtacatctggatcccccatcgtgaacagagaagggaaaatagtaggtctttatggaaatggagtagtgacaacaagtggaacctacgtcagtgccatagctcaagccaaagcatcacaagaagggcccctaccagagattgaagacgaagtgttcaggaaaagaaacttaacaataatggacctacatccaggatcggggaaaacaagaagatatcttccagccatagtccgtgaggccataaaaaggaagatgcgcacactaattctggctcccacaagggttgtcgcttccgaaatggcagaagcactcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagtaacgcagtcatccaagatgaggaaagagacattcctgagagatcatggaactcaggctatgagtggatcactgacttcccaggtaaaacagtctggtttgttccaagcattaaagcaggaaatgacattaccaactgcttaagaaagaatggaaaacgagtgattcaattgagcaggaagacctttgatacagagtaccaaaaaacaaaaaataacgactgggactacgtcgtcacaacagacatctccgaaatgggagcaaacttccgggccgacagggtgatggacccaagacggtgtctgaaaccggtaatactaaaagatggtccagagcgcgtcattttagcaggaccgatgccagtgactgtggccagtgccgcccagaggagaggaagaattggaaggaaccacaataaggaaggtgatcagtacatctacatgggacagcctttaaccaacgatgaagatcacgctcactggactgaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcccacaaagttgcctcagaaggcttccagtactctgacagaagatggtgctttgacggggaaaggaacaaccaggtgttggaggagaacatggacgtggagatttggacaaaagaaggagaaagaaagaagctacgcccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagataccatagaaacgttgatgctcctagctttgatagccgtgttaactggtggagtgacgctgttcttcctatcaggaaagggcctagggaaaacatctatcgggctactctgcgtgatggcttcaagcgtactgctatggatggccagtgtggagccccattggatagcggcctccatcatattggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcacccccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaacccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgctgttgatactatgcacatcacagatcctcttgatgcggactacatgggccttgtgcgaatccatcacactggccactggacctctgaccacactttgggaaggatctccaggaaaattttggaacaccacgatagcggtttccatggcaaacattttcagaggaagttatctagcaggagcaggtctggctttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattttttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacgggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgttatccccatggtcacacaaatagccatgactgacactacaccctttggacaacagagggtgtttaaagagaaagttgacacacgcacaccaaaagcaaaacgaggcacagcacaaatcatggtagtgacggccaggtggttatggagttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacacgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagagggtgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagcggagatgactgcgtagtgaaaccaattgatgataggtttgcgacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctgggtggagcctgagagaaactgcatgcctaggcaagtcatatgcacaaatgtggcagctgatgtacttccacaggagagacctgagactagccgctaatgctatctgttcagccgttccagttgattgggttccaactagccgcaccacttggtcgatccatgcccatcaccaatggatgacaacagaagacatgctgtcagtatggaatagggtttggatagaggaaaacccatggatggaggacaaaacccgtatatccagttgggaagatgttccatacctaggggaaagggaagatcaatggtgtggatctctgataggcttaacagcaagggccacctgggccaccaacgtacaagtggccataaaccaagtgagaagactaattgggaatgagaattattcggattacatgacatcaatgaagagattcaagaacaagagtgaacccgaaggggcactctggtga

SEQ ID NO: 144 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaactggtgatggctttcatagcattcctaagatttctagccatacccccaacagcaggaattttggctagatggggctcattcaagaagaatggagcgatcaaagtgctacgaggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcatcaggtgggaaatgaaagcacagaacatgggacaactgcaactataacacctcaagctcccacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacaacacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggctctgctgacatggctaggattaaactcaaggagcacgtccctttcgatgacgtgcattgcagttggcttagtaacgctatacttaggagtcatggttcaagcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagacgttgctgggatcttggctcaagggaaaaaaatgattaggccacaacccatggaacacaaatactcgtggaaaagctggggaaaggctaaaatcataggggcagatgtacagaacaccacctttatcatcgacggcccaaataccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttctttcttctcataatgggacaagtgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttacccaattccttggaggagctgggggatggacttgcaatgggcattatgattttaaaattattgactgacttccaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttctcatagcagaaaacaaaatctggggaaggaaaagttggcccctcaatgaaggaatcatggctgttggaattgtcagtatcttactaagttcactcctcaaaaatgatgtgccgctagctggaccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttgtgggacacacctagccctccagaagtggaaagagcagttcttgatgatggtatctatagaatcatgcagagaggactgttgggcaggtcccaagtaggggtaggagtttttcaggaaaacgtgtttcacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagccccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagctatccaagatgaggaaagagacattcctgagagatcatggaactcaggctatgagtggatcactgacttcccaggcaaaacagtttggtttgttccaagcatcaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaacaaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattagaaatagggaaacttccacaacacttaacgcaaagggcccagaatgccttggacaacctggttatgttgcacaattccgaacaaggaggaagagcctatagacatgcaatggaagaactgccagacaccatagaaacgttgatgctcctagctttgatagctgtgttgactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgactgccattgcaaaccaggcagctatcttgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcgaaagctactagagaagctcaaaaaaggacagcggccggaataatgaaaaatccaactgttgatggaatcgttgcaatagatttggaccctgtggtttatgatgcgaaatttgagaaacaactaggccaaataatgttgttgatactatgcacatcacagatccttttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattgatgaaatccctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactttggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgcgcaatatggtacatgtggttgggagcacgctttctagagttcgaagctcttggtttcatgaacgaagaccattggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaactagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgacatgggaaaagtaagaaaagatataccgcaatgggaaccctcaaaaggatggaatgattggcaacaagtgcctttttgttcacaccacttccaccagctgatcatgaaggatgggagggaaatagtggtgccatgccgcaaccaagatgaacttgtgggtagggctagagtatcacaaggtgctggatggagcctgagagaaaccgcatgcctaggcaaatcatatgcacaaatgtggcagctgatgtacttccacaggagagacctgagactagctgctaatgctatctgttcagccgttccagttgattgggtcccaaccagccgtaccacctggtcgatccatgcccaccaccaatggatgacaacagaagacatgctgtcagtgtggaatagggtctggatagaggaaaacccatggatggaggacaaaacccatatatccagttgggaagatgttccatatttagggaaaagggaagatcaatggtgtggatccctgataggcttaacagcaagagccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 145 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaaatggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgctgcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctgaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcatctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagagggctgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaatagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtttgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagctaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 146 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctccgcaggtgtcaacatgtgcacccttatagcgatggatttgggagagttttgtgaggacacaatgacttacaagtgccctcgaatcactgaggcggaaccagatgacgttgattgctggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggaaacttgggccctgagacacccaggattcacggtgatagccctttttctagcacatgccataggaacatccatcacccagaaagggattattttcattctgttaatgctggtaacaccatccatggcaatgcgatgtgtgggaataggtagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacagagaaaaaccagtcaacattgaggcagaaccgccttttggtgagagttacattgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaagtgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaataccctagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaaaccaaagcatcacaagaagggcctctaccagagattgaagacgaggtgtttaggaaaagaaacttaacaataatggacctacatccaggatcagggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggttcgtggataggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgctacagccttaactgctctgaatgatatgggaaaagttagaaaagatataccacaatgggaaccttcaaaaggatggaatgattggcaacaagtgcctttttgctcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttgggaagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 147 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacattacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcaacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagctccacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 148 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcagattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagccgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctcagacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcatctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 149 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacattacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 150 - DNA, 10179 bp, Dengue virus; identical to SEQ ID NO: 149

SEQ ID NO: 151 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaaatggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgctgcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttaacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctaatgatcaaagagcatggaacatttgggaagttgaggactatggatttggaattttcacgacaaatatatggttgaaattgcgtgactcctacactcaagcgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttgcgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaatagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggctataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 152 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacattcaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggcgtgtgtggaatacgatcaacaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagatcaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacaaagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgctgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagaccttggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaatccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcgattctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 153 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagcccttttcctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtaatcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaatgccaccttcatcatcgacggcccaaacaccccagaatgccctgacgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagctctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccactcctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggcattctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgacatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaactcacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 154 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagttactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccttgacatttgtcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgacgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgatcgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacattttaccgatccatccagcatagcggccagagggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgacctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagagactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 155 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtaatggctttcatagcattcctaagatttctagccatacctccaacagcaggaattttggctagatggggctcatttaagaagaatggagcgatcaaagtgctacggggtttcaagaaagaaatctcaaacatgctgaatataatgaatagaaggaaaagatctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggccgagacccagcatggaaccgttttagtgcagattaaatacgaaggaacagatgcaccatgcaagatccctttctcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctattggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagggagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagttggggaaaagctaaaatcataggggcagatgtgcagaacaccaccttcatcatcgacggcccaaacaccccagaatgccctgatgatcaaagagcatggaacatttgggaagttgaggactatggatttggaattttcacgacaaatatatggttgaaaatgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacactaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtaggaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaagagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcatccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcacttctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaagaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaagtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatagacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagccgtgttgactggtggagtgacgctgttcttcctatcaggaaggggcctagggaaaacatctatcggcttactctgcgtgatggcttcaagcgtactgctatggatggccagtgtggaaccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgcggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcactacgccataattggacctggattgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgacattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaagtagccaacctggatatcattggccagaggatagagaacataaaacatgagcacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagtgcaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgaaaaaagagagggagcttcacaaacagggaaaatgtgccacgtgtgtttacaacatgatggggaagcgagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaacatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaactgtgatggatgtcatatccagacgtgaccaaagaggaagtggccaggtcggaacttatggcttgaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttaattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 156 - DNA, 10179 bp, Dengue virus
atgaacaaccaacggaaaaagacggctcgaccgtctttcaatatgctgaaacgcgtgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggaaacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaataccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggtttaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacatgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagaggctggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgagggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctttatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggctttctcattaatgaaatctctaggaggaggtagaagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggttaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 157 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcactgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccttttcgatgacgtgcattgcagtcggcctagtaacgctatacttaggagtcatggttcaggcagattcaggatgtgtaattaactggaaaggtagagaactcaaatgtggaagtggcatttttgtcaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttttggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcggctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcatcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagactgatcccgaaggggcactctggtga

SEQ ID NO: 158 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacactgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcaccttcaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 159 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgagagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatggacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaatactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcgaactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcaacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 160 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaacataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgaggcacccaggattcacggtgatagccctctttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcttaataacgtgtgctaagttcaagtgtgtgacaaaactggaaggaaagatagttcaatatgaaaacttgaaatattcagtaatagttaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacgtttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggagaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccttttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggagaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccatactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaagatgctgatgactggaacactggctgtgttcctccttctcataatgggacaattgacatggaatgatctgatcagactatgcatcatggttggagccaacgcttccgacaggatggggatgggaacgacgtacctagctctgatggccacttttaaaatgagaccgatgtttgctgtagggctattatttcgcagactaacatccagagaagttcttctcctaacaattggattgagtctagtggcatctgtggagttaccaaattccttggaggagctgggggatggacttgcaatgggcattatgattttaaaattattgactgactttcaatcacatcagctgtgggctaccttgctgtccttgacattcatcaaaacaacgttttccttgcactatgcatggaagacaatggctatggtgctgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacatttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccttagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaaaggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctacgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaataaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttgtaccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagattagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 161 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaaccgcaactataacacctcaagctcctacgacggaaatacagctgaccgactacggagctcttacattggattgctcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagcaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatgggccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaagtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagatgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaagtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatctgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctaataagacaaatggagtctgagggaatcttttcacccagcgaattagagaccccaaatttagccgagagagttctcgactggctggaaaaatatggcgttgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 162 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatacaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 163 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggatacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagacttcaatgaaatggtgttgttgacaatgaaagaaaaatcatggctagtccacaaacaatggtttctagacctaccactgccctggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttccataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccatcggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtagatgaacattgtggaaatcgaggaccatctcttagaaccacaacagtcacaggaaagataattcatgaatggtgttgcagatcttgcacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttctcacaattggattgagtctagtggcatctgtggagttaccaaattccttggaggagctgggggatggacttgcaatgggcattatgattttaaaattattgactgactttcagtcacatcagctgtgggctaccttgctgtccttgacatttatcaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagccgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcaccgggcaccttcaagacccctgaaggtgaagttggagccattgccctagattttaaacccggcacatctggatctcccatagtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcctacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaggcagctgcgatcttcatgacagccactcccccaggatcagtggaggcctttccacagagcaatgcagttatccaagatgaggaaagagacatccctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccaatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactccgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacactgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgcgaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggattcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatcttttcacccagcgaattggagatcccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggcaacctgggcctctaacatacaagtggccataaaccaagtgagaagactaattgggaatgagaattatctagattacatgacatcaatgaagagattcaagaacgagggtgatcccgaaggggcactctggtga

SEQ ID NO: 164 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaaccgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatggaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggattatggatttggaattttcacgacaaacatatggctgaaattgcgtgattcctacacccaagtgtgtgaccaccggctaatgtcagctgccatcaaggacagcaaggcagttcacgccgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatttgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaggggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgcccactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggtcagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaggttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgagcatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 165 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggacttggtttggaaacaagaactgagacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagccatggttcaggcggattcgggatgtgtaattaattggaaaggtagagaactcaaatgtggaagtggcatttttgtcaccaatgaagttcacacttggacagagcaatacaaatttcaagctgactccccaaagagattatcagcagccatcgggaaggcatgggaggagggtgtgtgtggaatacgatcagcaactcgtctcgagaacatcatgtggaagcaaatatcaaatgaactgaaccacatcttacttgaaaatgatatgaaattcacagtggttgtaggagatgttgctggaatcttggctcaaggaaaaaaaatgattaggccacaacccatggaatacaaacactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttttggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtctggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgttagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctattcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatacacgaaaggaggacctggacatgaggagccaattccaatggcgacttatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccggggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggaggggaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 166 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaaatggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgctacttatgctgatgcccacagccttggcgttccacctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatggccctttttctagcacatgccataggaacgtccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaaggtagttcaatatgaaaacttgaaatattcagtaatagtcaccgtccacactggagaccagcaccaggtgggaaatgaaagcacagaacacgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatctggccaaaatcccacactctatggagcaatggagttctggaaagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgaccagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgatcttaaaattattgactgactttcagtcgcatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactccttaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggttcaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagactcctgaaggtgaagttggagccattgccctagattttaaacccggcacatctggatctcccattgtgaacagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttacacaactccgaacaaggaggaagagcctatagacatgcaatggaagaactgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcagatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccataggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 167 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttctcaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctattaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctctctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagcttatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgacctccagaatgaggccagaattactgacatcatggaacctgaacatgccctactggctaagtcaatcttcaagctaacctaccaaaataaggtggtaagggtacagagaccaacaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccagttgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 168 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcgatcaaagtgttacggggtttcaaaaaagagatctcaagcatgttgaacataatgaacaggaggaaaagatccgtgaccatgcttctcatgctactgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaacgccacagacacatgggtgacctatgggacgtgttctcaaaccggcgaacacagacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgctataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggccacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggggtgacccagaatgggagattgataacagccaatcccatagtcactgacaaagaaaaaccagtcaacattgagacagaaccgccttttggtgagagctacatcgtggtaggggcaggtgaaaaagctttaaaactaagctggttcaagaaaggaagtagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaagcagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggcaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgtcacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgctactgatactttgtacatcacagatcctcttgatgcggaccacatgggccttgtgtgaatccatcacactggctactggacccctgaccactctctgggagggatctccaggaaaattctggaatactacgatagcagtgtccatggcaaacatcttcaggggaagttatctagcaggagcaggtctggctttctcattaatgaaatctttaggaggaggcaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgccatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattacatgacatcaatgaagagattcaagagtgagagtgatcccgaaggggcactctggtga

SEQ ID NO: 169 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcgatcaaagtgttacggggtttcaaaaaagagatctcaagcatgttgaacataatgaacaggaggaaaagatccgtgaccatgcttctcatgctgctgcccacagccctggcgttccatttgaccacacgagggggagagccacacatgatagttaataagcaggaaagaggaaagtcactcttgtttaagacctccgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccatactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtctttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagacaccccagaatgccccgatgaccaaagagcgtggaacatttgggaagttgaggactatgggtttggaattttcacgacaaacatatggttgaaattgcgtgactcctacacccaaatgtgtgaccaccggcttatgtcagctgccatcaaggacagcaaggcagtccatgctgacatggggtactggatagagagtgaaaagaacgaaacctggaagctggcgagagcctccttcatagaagtcaagacatgcacctggccgaaatctcacactctatggagcaacggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggcccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacttagccttgatggctactttcaaaatgagaccaatgttcgctgttgggctattatttcgcagactaacatccagagaagttcttcttctcacgattggattaagcttggtggcatccgtggaactaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaattatggctattggaatagttagcatcctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagaaggatgacacactcactatactccttaaagcaactttgctggcagtctcaggagtgtacccaatgtcaataccagcgactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaaaactcctgaaggtgaagttggagccatagctctagattttaaacccggcacatctggatctcccatcgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcatgctcattggacagaagcaaaaatgctccttgacaatataaacacaccagaagggatcatcccagccctctttgagccagagagagaaaagagtgcagcaatagacggagagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaactgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaactccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgctgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaaaggatacacaaaaggaggacctggacatgaggaacctatcccaatggcgacctatggatggaacctagtaaagctacactctggaaaagatgtattttttatgccacccgagaaatgtgacacccttctgtgtgatattggtgagtcctctccgaatccaactatagaagaaggaagaacgttacgtgttttaaaaatggtggaaccatggctaagaggaaaccaattttgcataaaaatcctaaatccttacatgccaagtgtggtagaaactctggagcaaatgcaaagaaaacatggagggatgctagtgcgaaacccactctcaagaaattccacccatgaaatgtactgggtatcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttattcccatggtcacacaaatagccatgaccgataccacaccctttggacaacagagagtgtttaaagagaaagttgacacgcgcacaccaagagcaaaacgaggcacaacacaaattatggaggtgacagccaagtggttatggggtttcctctccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctaagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcctgaaggggcactctggtga

SEQ ID NO: 170 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcgatcaaagtgttacgaggtttcaaaaaagagatctcaagcatgttgaacataatgaacaggaggaaaagatccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggctctggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaacccagccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaaattcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggattttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttgaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgctttgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccctgatggctactttcaaaatgagaccaatgttcgctgttgggctattatttcgcagactaacatccagagaagttcttcttctcacgattggattaagcttggtggcatccgtggagctaccaaattctttggaggagctaggggatgggcttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtccacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcgggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctcctcgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactaggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgcgctgggctgaagaaagtcactgaagtgaagggatacacaaaaggaggacctggacatgaggaacctatcccaatggcgacctatggatggaacctagtaaagctatactctggaaaagatgtattttttatgccacctgagaaatgtgacacccttctgtgtgatattggtgagtcctctccgaatccaactatagaagaaggaagaacgttacgtattttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcacggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttttggagttcgaagcccttggtttcatgaatgaagatcactggtttagcagagagaattcactcagtggagtggaaggagaaggactgcacaaacttggatatatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgactgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 171 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcatttaagaagaatggagcgatcaaagtgttacgaggtttcaaaaaagagatctcaagcatgttgaacataatgaacaggaggaaaagatccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaaattcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggattttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttgaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatgggcttgcaatgggtatcatgatgttaaaattattgactgaatttcagccacaccagttatggaccaccttactgtccctaacattcatcaaaacaactctttcattggattatgcatggaaaacaacggctatggcactgtcgatcgtatctctctttcctttatgcctgtctacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcagctgaggtgtcctgggaacaagaggcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggtaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcgggctacgactggatcactgattttccaggtaaaacagtctggtttgtcccaagtattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctcctcgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgctgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagctgccgaaaaccaccaacatgctacaatgctggatgtagacctacgtccagcttcagcctggactctttatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagctaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcacggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 172 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcgatcaaagtgttacgaggtttcaaaaaagagatctcaagcatgttgaacataatgaacaggaggaaaagatccgtgaccatgcttctcatgctgctgcccacagccctggcgttccatttgaccacacgagggggagagccacacatgatagttagtaagcaggaaagaggaaagtcactcttgttcaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacatttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggtatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactctgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggggttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgaaagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactcagatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggagaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccactcatgaaatgtactgggtttcatgtggaacaggaaacattgtgtcggcagtgaacatgacatccagaatgttactgaatcgattcacaatggctcacaggaagccaacatacgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcattgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggatgggacacaagagtaacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgagaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatttagattatatgacatcaatgaagagattcaagaatgagagtgatcccgaaggggcactctggtga

SEQ ID NO: 173 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcgatcaaagtgttacggggtttcaaaaaagagatctcaagcatgttgaacataatgaacaggaggaaaagatccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgttggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactagtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagtcaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcattcaagctagagaaggaagtggctgagacccaacatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagcgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcaggttaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcactggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagcgatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcatgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtaacaacaagtggaacctacgtcagtgccattgcccaagctagagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagataccagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggccttcccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggattatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacactgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagtcatcactcccatgatgagacacacaattgaaaatacaacggcaaacatttccctgacagccattgcaaatcaggcagctatattgatgggacttgacaagggatggccaatatcaaagatggacataggagttccacttctcgccttagggtgctattcccaggtgaacccattgacactgacagcggcggtgttgatgttagtggctcattatgccataattggaccaggactgcaagcaaaagccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaacccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattatcggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaggtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatcttttcacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 174 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcaatcaaagtgttacggggtttcaaaaaagagatctcaagcatgttgaacataatgaacaggaggaaaagatccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgtaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggttttgagacacccaggattcacggtgatagccttttttttagcacatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaactcacagtggttgtaggagatgccaacggaattttggcccaagggaaaaaaatgattaggccacaacctatggaacacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtaggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagacttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattataacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctataaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatctagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaagcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatacttagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgtcatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggctagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 175 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcaatcaaagtgttacggggtttcaaaaaagagatctcaagcatgttgaacataatgaacaggaggaaaagatccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgtaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatacggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaactcacagtggttgtaggagatgccaacggaattttggcccaagggaaaaaaatgattaggccacaacctatggaacacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaaccatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtaggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattataacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaaggaatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatctagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagccatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaagcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatacttagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgtcatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggctagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaagacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 176 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggcttttatagcatttctaagatttctagccatacccccaacagcaggaattttggctagatggagctcattcaagaagaatggagcgatcaaagtgttacggggtttcaaaaaggagatctcaagcatgttgaatattatgaacaggaggaaaaaatctgtgaccatgcttctcatgctgctgcccacagccctggcgttccatttgactacacgagggggagagccacacatgatagtcagtaagcaggaaagaggaaagtcactgttgttcaagacctctgcaggcatcaacatgtgcactctcattgcgatggatttgggagagttatgcgaggacacaatgacctacaaatgcccccggatcactgaggcggaaccagatgacgttgactgctggtgcaatgccacagacacatgggtgacctacgggacgtgttctcaaaccggcgaacaccgacgagacaaacgttccgtggcactggccccacacgtgggacttggtctagagacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatactagtaacaccatcaatggccatgcgatgtgtgggaataggcaacagagacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacaccccaagctccaacgtcggaaatacagctgactgactacggagccctcacattggactgctcgcctagaacagggctggactttaatgagatggtgctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagcgggaaaattggtacaccaggtttttggagccgcatatggggttctattcagcggagtttcttggaccatgaaaataggaatagggattctgctgacatggttgggattaaattcaaggagcacgtcactttcgatgacgtgcattgcggttggcatggtcacactgtacctaggagtcgtggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttagcccaagggaaaaaaatgattaggccacaacccatggaacatagatactcatggaaaagctggggaaaagccaaaatcataggagcagacatacagaatgccaccttcatcatcgacggcccagatactccagaatgccccgatgaccaaagagcgtggaacatttgggaagttgaagactatggttttggaattttcacgacaaacatatggctgaaattgcgcgactcctacacccaaatgtgtgaccaccggctaatgtcagctgccatcaaagacagcaaggcagtccatgctgacatggggtactggatagaaagcgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcagcacaactacagaccagggtatttcacacaaacagcagggccgtggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacactggctgtttttctccttcttataatgggacaactgacatggaaagatctgattaggttatgcatcatggttggagctaatgcttcagacaggatggggatgggaacaacgtacctggccttgatggccactttcaaaatgcgaccaatgttcgctgttgggctattatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacattcatcaacacaactctttcattggattatgcatggaggacaatggctatggtgctatcaatcatatctctctttcctttatgtctgtctacgacctcccaaaaaacaacatggcttccggtgctgttaggatcttttggatgcaaaccattaaccatgtttcttataacagaaaacaaaatttggggaaggaaaagctggcccctcaatgaaggaattatggctattggaatagtcagcattctactaagttcactccttaaaaatgatgtgccgttagccggcccactaatagctggaggcatgctaatagcatgttatgtcatatccggaagttcagccgatttatcattggagaaagcagctgaggtatcctgggaagaagaagcagaacactctggtacctcacacaacatattagtagaggtccaagatgatggaaccatgaaaataaaagatgaagagagggatgacacactcaccatactcctcaaagcaactctgctggcagtctcaggagtgtacccaatgtcaataccagcaactcttttcgtgtggtatttttggcagaaaaagaaacaaagatcaggagtgttatgggacacacccagccctccggaagtggaaagagcagttcttgatgatggcatctatagaatcctgcaaagaggactgttgggcaggtcccaagtaggagtgggagttttccaagacggcgtcttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagctgttgaaccaggaaaaaatcccaaaaatgtacagacaacgccgggtaccttcaagactcccgaaggcgaagttggagccatagctctagactttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggacgaggtgtttaagaaaaggaacttaacaataatggacctgcatccaggatcgggaaagacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgatcatcatggatgaagcacactttaccgatccagccagcatagcggccagagggtacatctcaactcgagtgggtatgggtgaagcagctgcgatctttatgacagccactcccccaggatcggtggaggcctttccacaaagcaatgcagttatccaagatgaggaaagagacattccagagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggaccacgctcattggacagaagcaaaaatgctccttgacaatataaacacaccagaagggatcattccagccctctttgagccagagagagaaaagagtgcagcaatagatggggagtacagactgcggggagaagcaaggaaaacattcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggcccttcgtgagttcaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttctttctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggactattggaaaccacaaagaaagacctggggattggccatgttgccgccgaaaaccaccaccatgccacgatgctggacgtagacctacgcccagcttcagcctggaccctctatgcagtagccacaacagttatcactcccatgatgagacacacaattgaaaacacaacggcaaacatttccctgacggccattgcaaaccaggcagctatattgatgggacttgataagggatggccaatatcgaagatggacataggagttccacttctcgccttagggtgctattcccaggtgaacccattgacactgacagcagcggtgttgatgttagtggctcattatgccataattggaccaggactccaagcaaaggccactagagaagctcaaaaaaggacagcggccggaataatgaaaaatccaaccgtagacgggattgtcgcaatagacttggatcctgtggtttatgatgcaaaatttgaaaaacagttaggccaaataatgttactgatactttgcacatcacagattctcttgatgcggaccacatgggccttgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccagagagggattaaaaagaggagaaacaaccaaacatgcagtgtcgagaggaacagccaaactgaggtggtttgtggagagaaacctcgtgaaaccagaagggaaagtcatagacctcggttgtggaagaggtggctggtcatattattgtgctgggctgaagaaagtcactgaagtcaagggttacacaaaaggaggacctggacatgaggaacctatcccaatggcgacctatggatggaacctagtaaagctatactctggaaaagatgtgttttttataccacctgagaaatgtgatacccttctgtgtgatataggagagtcctctccgaatccaactatagaagaaggaagaacgttacgtgttctaaagatggtagaaccatggctcagaggaaaccaattctgtataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcatcggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtaagattgctcacaaaaccatgggatgtcatccccatggtcacacaaatagccatgaccgataccacacccttcggacaacagagagtgtttaaagagaaagtagacacgcgcacaccaagagcaaaacgaggcacagcacaaattatggaggtgacagccaagtggttatggggtttcctttccagaaacaaaaaacccagaatctgtacaagagaggagttcacaagaaaggttaggtcaaacgcagcaataggagcagtgttcgttgatgaaaaccaatggaactcagcaaaagaagcagtggaagacgaaaggttttggaatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggttcagtagagagaattcatttagtggagtggaaggagaaggactgcacaaacttggatacatactcagagacatatcaaagatcccggggggaaatatgtatgcagatgacacagccggatgggacacaagaataacagaggatgatcttcaaaatgaggctaaaatcactgacatcatggagcctgaacacgctctattggctacgtcaatttttaagctgacctaccaaaacaaggtggtaagagtgcaaagaccagcaaaaaatggaaccgtgatggatgttatatccagacgagaccagagaggaagtgggcaagtcggaacctatggcttaaatactttcaccaatatggaggtccaactaataagacaaatggagtctgaaggaatctttttacccagcgaattggaaacccccaatctagctgagagagttcttgactggttggaaaaacatggcaccgaaaggctgaaaagaatggcaattagcggagatgattgtgtggtgaaaccagttgacgagaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggtcccaaccagccgcacaacctggtcaatccatgctcaccatcaatggatgacaacagaagacatgttatcagtgtggaatagggtttggatagaggaaaacccatggatggaggacaaaactcatgtatccagctgggaagaagtcccatacttagggaaaagggaagatcaatggtgtggatccctgataggcttgacagctagggccacttgggccactaacatacaagtagccataaaccaagtgagaaggctcatcgggaatgagaattatctagattacatgacatcaatgaagagattcaagaatgagagtgatcccgaaggggcactctggtaa

SEQ ID NO: 177 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacatccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaaatggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggttcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttctgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatttacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaagacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaagaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggcttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaagtggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 178 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggatcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgtaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccactagctgggccactaatagctggaggcatgctaatagcatgttatgttatatctggaagctcagccgacctatcactagagaaagcagctgaggtctcctgggaagaagaagcagaacactctggcgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtatcaggtgatctaatattagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattgatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgtactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtacccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggatcttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagagtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 179 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaaggaaaaaaaatgattaggccacaacctatggaacacaaatactcgtggaaaagctggggaaaagctaaaatcataggggcagacgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctacagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacatttttagaggaagttatctagcaggagcaggtctggccttctcattaatgaaatccttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaactagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcagatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgaaagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 180 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtaatggctttcatagcattcctaagatttctagccatacctccaacagcaggaattttggctagatggggctcattcaagaagaatggagcgatcaaagtgctacggggtttcaagaaagaaatctcaaacatgctgaacataatgaatagaaggaaaagatctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgagacggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttttagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggttgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagagagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaaccgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgttgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttctcatagcagaaaacaaaatctggggaaggaaaagttggcccctcaatgaaggaatcatggctgttggagtagtcagtatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctacgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggcaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactacaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaaatcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaatatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtagtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgccaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 181 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggcgtcaacatgtgcacccttatagcgatggatttgggagagttttgtgaggacacaatgacttacaagtgccctcggatcactgaggcggaaccagatgacgttgattgttggtgcaatgccacagacacatgggtgacctatggaacatgtacccaaattggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggcaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaattgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaatagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggaatacaaatactcgtggaaaatctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacaggccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgatcatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacaggtccgaagccaaagagggactgaaaagaggagaaacaaccaaacatgcagtgtcgagaggaacagctaaactgaggtggtttgtggagaggaatctcgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagtggagtggaaggagaaggactccacaaacttggatacatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagttaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 182 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgctactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattgtgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaagctctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 183 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagtcgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatatcagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 184 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctggtgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttggacttaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcactaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactttatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtttagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaaaggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggatcatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtattcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtagccataaaccaagtgagaagactaattgggaatgagaattatctagattacatgacatcaatgaagagattcaagaacgagagtgatcccgaaggggcactctggtga

SEQ ID NO: 185 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttctgttcagcggtgtttcctggaccatgaaaataggaataggggttctgctgacatggctaggattaaattcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcgtgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaacactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaaccacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgcacgctaccacccttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcttactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggctggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccattgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcccttaaacaacgacgaagatcacgctcactggaccgaagcaaaaatgctccttgataatataaacacaccagaagggattatcccagccctctttgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatatcagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctccttgctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattattgcaatagatttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgcgacacccttttgtgtgatattggtgagtcctctccaaacccaaccatagaagaaggaagaacgttacgcgtcctaaaaatggtggaaccatggctcagagggaaccaattttgcataaaaattctgaatccctacatgccaagtgtggtggaaactctggaacaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtaagaagactaattgggaatgagaattatctagattacatgacatcaatgaagagattcaagaacgagggtgatcccgaaggggcactctggtga

SEQ ID NO: 186 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttctcaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctattaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagctaacctaccaaaataaggtggtaagggtacagagaccaacaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccagttgatgataggtttgcaacagccttgacagctctgaatgatatggggaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 187 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaacagaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggggtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgatcaccggctaatgtcagctgccatcaaggacagcaaggcagttcacgctgacatggggtactggatagaaagtgaaaagaacgagacctggaagctggcaagagcctccttcatagaagttaaaacatgtatctggccaaagtcccacactctatggagcaatggagttctggaaagtgaaatgataattccaaagaactatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgctcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacaacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaactatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacctaacaataatggacctacatccaggatcggggaaaacaagaagatatcttccagccatagtccgtgaggccataaaaaggaagctgcgtacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcctccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaagcttccacaacacttgacgcaaagggcccagaacgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgttgacagcggcggtgttgatgctagtggctcattacgccataattggacctggactgcaagcaaaagctactagagaagctcaaaaaaggacagcggccggaataatgaagaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttacctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatctatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagtttacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggacacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaagagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagttagaagactaattgggaatgagaattatctagattacatgacatcaatgaagagattcaagaacgagagtgatcctgaaggggcactctggtga

SEQ ID NO: 188 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaagatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattattactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 189 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggcgtcaacatgtgcacccttatagcgatggatttgggagagttttgtgaggacacaatgacttacaagtgccctcggatcactgaggcggaaccagatgacgttgattgttggtgcaatgccacagacacatgggtgacctatggaacatgtacccaaattggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggcaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaattgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaatagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaagagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttaaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggaatacaaatactcgtggaaaatctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacaggccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaagggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactactattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgatcatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacaggtccgaagccaaagagggactgaaaagaggagaaacaaccaaacatgcagtgtcgagaggaacagctaaactgaggtggtttgtggagaggaatctcgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatacatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagttaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 190 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaaccggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacaggccaggatatttcacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagcagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatcactcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcttactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggccactaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatctgaagccaaagaaggattgaaaagaggagaaacaaccaaacatgcagtgtcgagaggaaccgctaaactgaggtggtttgtggagaggaaccttgtgaaacctgaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccaagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 191 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcgatcaaagtgttacgaggtttcaaaaaagagatctcaagcatgttgaacataatgaacaggaggaaaagatccgtgaccatgcttctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggtatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagcaaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacagggaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactcagatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttgtggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgttacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatacgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcattgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggatgggacacaagagtaacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgagaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagctgatcatgaaggatgggagagaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 192 - DNA, 10179 bp, Dengue virus; identical to SEQ ID NO: 181

SEQ ID NO: 193 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttctgttcagcggtgtttcctggaccatgaaaataggaataggggttctgctgacatggctaggattaaattcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcgtgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaaccacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgcacgctaccacccttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcttactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggctggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccattgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcccttaaacaacgacgaagatcacgctcactggaccgaagcaaaaatgctccttgataatataaacacaccagaagggattatcccagccctctttgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatatcagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctccttgctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattattgcaatagatttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgcgacacccttttgtgtgatattggtgagtcctctccaaacccaaccatagaagaaggaagaacgttacgcgtcctaaaaatggtggaaccatggctcagagggaaccaattttgcataaaaattctgaatccctacatgccaagtgtggtggaaactctggaacaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtaagaagactaattgggaatgagaattatctagattacatgacatcaatgaagagattcaagaacgagggtgatcccgaaggggcactctggtga

SEQ ID NO: 194 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaaccggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacaggccaggatatttcacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagcagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatcactcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagttagcatcttactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggccactaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatctgaagccaaagaaggattgaaaagaggagaaacaaccaaacatgcagtgtcgagaggaaccgctaaactgaggtggtttgtggagaggaaccttgtgaaacctgaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccaagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 195 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcttgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 196 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagcgatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcccacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggaaacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtgctggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaaccgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagccgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgttttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcacgaaatgtattgggtttcatgtggaacaggaaacattgtgtcagcagtaaacatgacatccagaatgttgctaaaccgattcacaatggctcacaggaaaccaacatatgaaagagacgtggacctaggtgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccgtgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 197 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttctcaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaattacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctattaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctctctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagcttatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgacctccagaatgaggccagaattactgacatcatggaacctgaacatgccctactggctaagtcaatcttcaagctaacctaccaaaataaggtggtaagggtacagagaccaacaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccagttgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 198 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcgaaaggattgctctcaggccaaggacccatgaaattggtgatggctttcatagcattcctaagatttctagccatacccccaacagcaggaattttggctagatggggctcattcaagaagaatggagcgatcaaagtgcttcggggtttcaagaaagaaatctcaaacatgttgaatataatgaatagaaggaaaagatctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggtttattcaagctagagaaagaagtggctgagacccagcatggaaccgttttagtgcagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatccgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtagaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattataacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacttttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcctagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgacaatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagaccttggttgtggaagaggtggctggtcatactattgcgctgggctgaagaaagtcacagaagtgaagggatacacaaaaggaggacccggacatgaagaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagattagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgatagtgatcccgaaggggcactctggtga

SEQ ID NO: 199 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacgtttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgtcctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgcaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtggggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaggaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcagggaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgatggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttttgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgcggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgaaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 200 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagctttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgccaagttcaagtgtgtgacaaaactggaaggaaagatagttcaatatgaaaacttgaaatattcagtaatagtcaccgtccacacaggagaccagcaccaggtggggaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtacagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacattttacttgaaaatgacatgaaactcacagtggttgtaggagatgttgctggaatcttggctcaaggaaaaaaaatgattaggccacaacccatggaatacaaatactcatggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgacttccaatcacatcagttgtgggctaccttgctgtccttgacatttatcagaacaacgttttccttgcactatgcatggaagacaatggcaatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactgagttcactcctcaaaaatgatgtgccgctagctgggccactaatagctggaggcatgctaatagcatgttatgttatatctggaagctcagccgatctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagatatctccgaaatgggagcaaatttccgggccgacagggtgatagacccaagacggtgtctgaaaccggtaatactaaaagatggtccagagcgtgtcattttagcaggaccgatgccagtgactgtagccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagttcaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccggcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggttaagccgtcagggtcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttgggaagatgttccatatttgggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 201 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacgttgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagttacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctattaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcactatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcagtggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 202 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttataaatgccctcgaatcactgaaactgaaccagatgacgttgattgttggtgtaatgccacagacacatgggtgacctatggaacatgttcccaaactggcgagcaccggcgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacagaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcacaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaattataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactactatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaagatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacttacatccaggatcggggaaaacaagaagatatcttccagccatagtccgtgaggccataaaaaggaagctgcgcacactaattctggctcccacgagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatatgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttgaacactttcaccaacatggaagcccagctgataagacaaatggagtctgagggaatcttctcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 203 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggcgtcaacatgtgcacccttatagcgatggatttgggagagttttgtgaggacacaatgacttacaagtgccctcggatcactgaggcggaaccagatgacgttgattgttggtgcaatgccacagacacatgggtgacctatggaacatgtacccaaattggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggcaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaattgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaatagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaagagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggaatacaaatactcgtggaaaatctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacaggccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaagggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactactattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgatcatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacactgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacaggtccgaagccaaagagggactgaaaagaggagaaacaaccaaacatgcagtgtcgagaggaacagctaaactgaggtggtttgtggagaggaatctcgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatacatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagttaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 204 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccactttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattattactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 205 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcatagtgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcagttgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagttgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataagataccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaagaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaagtatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 206 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatctgactacacgagggggagagccgcacatgatagtcagcaagcaggaaagaggaaagtcactcttgtttaagacctcagcaggtgttaacatgtgcacccttatagcgatggatttgggagagttatgtgaggacacaataacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggcaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacaccccaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggtacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacggcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtagaaactctggagcaaatgcaaagaaaacatgggggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 207 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcgaaaggattgctctcaggccaaggacccatgaaattggtgatggctttcatagcattcctaagatttctagccatacccccaacagcaggaattttggctagatggggctcattcaagaagaatggagcgatcaaagtgcttcggggtttcaagaaagaaatctcaaacatgttgaatataatgaatagaaggaaaagatctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggtttattcaagctagagaaagaagtggctgagacccagcatggaaccgttttagtgcagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatccgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagctaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtagaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccggggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattataacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgacaatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacatagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagaccttggttgtggaagaggtggctggtcatactattgcgctgggctgaagaaagtcacagaagtgaagggatacacaaaaggaggacccggacatgaagaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcacttagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagattagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgatagtgatcccgaaggggcactctggtga

SEQ ID NO: 208 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgactacacgagggggggagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctagtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcatttaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaatcgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatggcaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacattgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactaagcaagtcagaatttaacacctataaaaggagtgggatcatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccgaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatgggggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggatctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagatcccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgaaaaaatatggcgtcgaaaggctgaaaagaatggcaatcagcggagatgactgcgtagtgaaaccaattgatgataggtttgcaacagccttgacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 209 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagggacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacattatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcttgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacacggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacaccatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 210 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgagactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagcgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgaaggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 211 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacgtttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgtcctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaggaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgatggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttttgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccgagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgaaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttgggaagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 212 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacttgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctctaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaaaatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagagatagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacacaacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaatgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaagccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgactggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 213 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgttggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggctatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagacgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgctctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgtcccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataacataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtgctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggctgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacctagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatacttaggaaaaagggaagaccaatggtgtggatccctgataggcttaacagcaagggccacctgggccaccaatatacaagtggccataaaccaagtgagaagactaattgggaatgagaattatctagattacatgacatcaatgaagagattcaagaacgagagtgatcccgaaggggcactctggtga

SEQ ID NO: 214 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaagatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattattactcccatgatgaggcacacaatcgaaaacacaacggcaaacatttccctgacagccattgcaaaccaggcagctatattaatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 215 - DNA, 10179 bp, Dengue virus; identical to SEQ ID NO: 214

SEQ ID NO: 216 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctctttggaaaagggagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctctcgatgacgtgcattgcagttggcctagtaacactatacctaggagtcatggttcaggcggattcaggatgtgtaataaattggaaaggtagagaactcaaatgtggaagtggcattttcgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccatcggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggtcaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaagcgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatatcagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccattatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggctggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcacaaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccataaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcatcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcaatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 217 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttaggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaagcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctaactctaaaagggatgtcatatgtaatgtgcacaggctcattcaagctagagaaagaagtggctgagacccagcatggaaccgttctagtgcagattaaatatgaaggaacagatgcaccatgcaagatacctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacatcagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtgattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaacacaaatactcatggaaaagctggggaaaggctaaaatcataggggcagatgtgcagaatgccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcattatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctcctgaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggcccccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgccttctgtctcccgtgagagttcccaattacaacatgattatcatggatgaagcacatttcaccgatccatccagcatagcggccagagggtacatctcaacccgagtgggtatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcagggaggggcctagggaaaacatctatcggcctactctgtgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatacaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtctccatggcaaacatttttagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttctgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcaacagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagattgatcctgaaggggcactctggtga

SEQ ID NO: 218 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagatacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaatagggattctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataataatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatactggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactatgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaattatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaagactgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 219 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgactacacgagggggggagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctagtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcatttaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaatcgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatggcaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacatttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacattgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactaagcaagtcagaatttaacacctataaaaggagtgggatcatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatgggggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagatcccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgaaaaaatatggcgtcgaaaggctgaaaagaatggcaatcagcggagatgactgcgtagtgaaaccaattgatgataggtttgcaacagccttgacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 220 - DNA, 10179 bp, Dengue virus
atgaacaaccaacggaaaaagacggctcgaccgtctttcaatatgctgaaacgcgtgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagaatggagcgatcaaagtgctacggggtttcaagaaagaaatctcaaacatgttgaatacaatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcatcttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgctggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgatatggggtactggatagaaagtgaaaagaacgagacctggaagctggcaagagcctctttcatagaagttaaaacatgtatctggccaaaatcccacactctatggagcaatggagttctggaaagtgaaatgatagttccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataataatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccggggaaaaaccccaaaaatgtacaaacagcgccgggcacttttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcgggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaggcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctgcgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggtcagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcctaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccatcagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgaacccgaaggggcactctggtga

SEQ ID NO: 221 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcgaaaggattgctctcaggccaaggacccatgaaattggtgatggctttcatagcattcctaagatttctagccatacccccaacagcaggaattttggctagatggggctcattcaagaagaatggagcgatcaaagtgcttcggggtttcaagaaagaaatctcaaacatgttgaatataatgaatagaaggaaaagatctgtgaccatgctccttatgctgatgcctacagccttggcattccatttgactacacgaggaggagagccgcacatgatagttagcaagcaggaaagaggaaagtcacttttgttcaagacctcagcaggtgtcaacatgtgcaccctcatagcgatggatttaggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacctgggccctgagacacccaggattcacggtgatagccctttttctagcacatgctataggaacatccatcacccagaaagggattattttcattctgttaatgctagtgacaccttccatggccatgcgatgcgtgggaataggcagcagggacttcgtggaaggactgtcaggagcaacttgggtagatgtggtactggaacatggaagctgcgtcaccaccatggcaaaagacaaaccaacattggacattgaactcttgaggacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttctagtgcagattaaatacgaaggaacagatgcaccatgcaagatccccttttcgacccaagatggaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtcactttcgatgacgtgcattgcagttggtctagtaacactatacctaggagtcatggttcaggcggattcaggatgtgtaattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaatcacatcttacttgaaaatgacatgaaattcacagtagttgtaggagatgttgttgggatcttggctcagggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagttggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggtcggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgttaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggtgtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggtacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacattaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgatcatcatggatgaagcacatttcaccgatccatccagcatagcggccagaggatacatctcaactcgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaagcgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtttgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcctttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtttcaggtgatttaatattagaaatagggaaactcccacaacacttgacgcaaagggcccagaatgccttggacaacctggtcatgttgcacaactccgaacaaggaggaagagcctatagacatgcaatggaagaactcccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatagccagtgtggagccccattggatagcggcctccatcatactggagttcttcttgatggtgctgcttattccagagccagacagacaacgcacaccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaattgagcaagtcagaatttaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaatatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacgaggcactgcacaaatcatggaggtgacagccagatggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgagcggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagtagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaatatggcgtcgaaaggctaaaaagaatggcaatcagcggagatgactgcgtggtgaaaccaattgatgacaggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 222 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaatcctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatgtctcagcacaactacaggccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagcagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatcactcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcttactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaacctgaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgttatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccaagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccatttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 223 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacgtttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgtcctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgtcatatctggaagctcagccgacctatcattagagaaagcggctgaggtctcctgggaagaggaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgatggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttttgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccgagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgaaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttgggaagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 224 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggctactggacctctgaccacgctttgggagggatctccaggaaaattttggaacaccacgatagcggtttccatggcaaacattttcagagggagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 225 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacttgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtaacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctctaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaaaatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagagatagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacacaacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaatgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaagccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgactggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 226 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccacgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaatcctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatgtctcagcacaactacaggccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagcaaaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatcactcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcttactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaacctgaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgttatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccaagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggctaccaacatacaagtggccataaaccaagtgagaagactaattgggaatgagaattatctagattacatgacatcaatgaagagattcaagaacgagagtgatcccgaaggggcactctggtga

SEQ ID NO: 227 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttggatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtagcatctgtggagttaccaaattccttggaggagctgggggatggacttgcaatgggcattatgattttaaaattattgactgattttcaatcacatcagctgtgggccaccttgctgtccttgacatttatcaaaacaacgttgtccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaaggtatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctatcggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattattactcccatgatgaggcacacaatcgaaaacacaacggcaaacatttccctgacagccattgcaaaccaggcagctatattgatgggacttgacaaaggatggccaatatcgaagatggacataggagttccactcctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttattgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 228 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcacagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaacacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagcggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccttacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggactctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 229 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaaatggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgctgcttatgctgatgcccacagccttggcgttccatctgactacacgagggggagagccgcatatgatagttaccaagcaggaaagaggaaagtcacttttgtttaagaccacagcaggcgtcaacatgtgcacccttatagcgatggatttgggagagttatgtgaggacacaatgacttacaaatgccctcggatcactgaggcggaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaactcgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 230 - DNA, 10179 bp, Dengue virus; identical to SEQ ID NO: 191

SEQ ID NO: 231 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 232 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaagatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgttcaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagaaagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattattactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 233 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacaggccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggcatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagcagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatcactcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcttactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaacctgaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccaagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 234 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcggatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcctgaagacggaagtcacaaaccctgccgtcctgcgtaaactgtgcattgaagctaaaatatcaaataccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagctacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagccgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacagggaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaagaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtatcgagaggaacagctaaactgaggtggtttgtggagaggaatcttgtgaaaccagaagggaaagtcatagacctcggttgtggaagaggtggctggtcatactactgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcgaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagtggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgatcatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 235 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcgatcaaagtgttacgaggtttcaaaaaagagatctcaagcatgttgaacataatgaacaggaggaaaagatccgtgaccatgcttctcatgctgctgcccacagccctggcattccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgtaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaaccttggacattgaactcttgaagacggaggtcacgaaccctgccatcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagcctattgacgtgtgccaaatttaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggattttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttgaaagggacgtcatatgtgatgtgcataggctcatttaagctagagaaggaagtggctgagacccagcatggaactgttttagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggaatgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagttacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataacgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatgggcttgcaatgggtatcatgatgttaaaattattgactgaatttcagccacaccagttatggaccaccttactgtctctaacattcatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccgttaactatgtttcttataacagaaaataaaatctggggaaggaaaagttggcccctcaatgaaggaattatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatattagtagaggtccaagatgatggaactatgaaaataaaagatgaagagagggacgacacactcactatactccttaaagcaactttgctggcagtctcaggagtgtacccaatgtcaataccagcaactctttttgtgtggtacttttggcagaaaaagaaacagagatcaggagtgttatgggacacacccagtcctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaaggaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcgggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctcctcgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttagaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacagggaggaaaagcctatagacatgccatggaggaactaccagacaccatagaaacattgatgcttctagctttgatagctgtgctgactggtggagtgacgctgttcttcctatcaggaaaaggtctagggaaaacatccatcggcctgctctgtgtgacggcctcaagcgcactgttgtggatggccagtgtggagccccattggatagcagcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggccatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcactatgatgaggacaatccatacaaaacatgggcctatcacggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgctctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaatgacatgggaaaagtaagaaaagacataccgcagtgggaaccttcaaaaggatggaatgattggcagcaagtgcctttctgttcacaccatttccaccagttgatcatgaaggatgggagggaaatagtggtgccatgccgcaaccaagatgaacttgtgggcagggctagagtatcacaaggcgctggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattatatgacatcaatgaagagattcaagaatgagagtgatcccgaaggggcactctggtga

SEQ ID NO: 236 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcgatcaaagtgttacggggtttcaaaaaagagatctcaagcatgttgaacataatgaacaggaggaaaagatccgtgaccatgcttctcatgctgctgcccacagccctggcgttccatttgacaacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccagatcactgaggcggaaccagatgacgttgactgctggtgcaatgccacagacacatgggtgacctatgggacgtgttctcaaaccggcgaacaccgacgagacaaacgttccgtggcattggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcacccagaaagggatcattttcattttgctgatgctggtgacaccatcaatggccatgcgatgcgtgggaataggcaacagagacttcgttgaaggactgtcaggagcaacgtgggtggacgtggtattggagcatggaagctgtgtcactaccatggcaaaaaataaaccaaccttggacattgaactcttgaagacggaggtcacgaaccctgccatcttgcgcaaactgtgtattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcgaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacatctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttaaaactaagctggttcaagaaaggaagcagcatagggaaaatgttcgaagcaaccgcccgaggagcacgaaggatggctattctgggagacaccgcatgggactttggctccataggaggagtgttcacatctgtgggaaaattggtacaccaggtttttggaaccgcatatggggttctgttcagcggtgtttcttggactatgaaaataggaatagggattctgctgacatggttgggattaaattcaaggagcacgtcactttcgatgacgtgcattgcagttggcatggttacactatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaacgactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgataaccaaagagcgtggaacatttgggaagttgaggactatgggtttggaattttcacgacaaacatatggttaaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactatagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctgacattcatcaaaacaactctttcattggattatgcatggaaaacaacggctatggcactgtcaatcgtatctctccttcctttatgcctgtctacgacctcccaaaaaacaacatggcttccggtgctgttaggatcttttggatgcaaaccgttaactatgtttcttataacagaaaacaaaatctggggaaggaaaagttggcccctcaatgaaggaatcatggctattggaatagttagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacacttactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcatgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggatttgatctcatatggaggaggttggaggtttcaaggatcatggaacacgggagaagaagtgcaggtgatagctgttgaaccaggaaaaaaccccaaaaatgtacagacaacgccgggcaccttcaagactcttgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttactatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgtcccaagtattaaatcaggaaatgacattgctaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccattggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctgtcaggaaaaggtctagggaaaacatccatcggcctgctctgtgtgacggcctcaagcgcactgttgtggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacttacgtccagcttcagcctggactctctacgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagagggaagaacgttacgtgttttaaaaatggtggaaccatggctaagaggaaaccaattctgcataaaaatcctaaatccttacatgccaagtgtggtagaaactctggagcaaatgcaaagaaaacatggagggatgctagtgcgaaacccactctcaagaaattcctcccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcttcatctatggtgaatggagtggtgagattgctcacaaaaccatgggatgttatccccatggtcacacaaatagctatgaccgataccacaccctttggacaacagagagtgttcaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtttacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggttgggacacaagaataacagaggatgatcttcagaatgaggctaaaatcactgacatcatggagcctgaacatgccctattggctacgtcaatttttaagctgacttatcaaaacaaagtggtgagggtgcaaagaccagcaaaaaacggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgctacagccttaacagccctgaacgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattacatgacatcaatgaagagattcaagaatgagagtgatcccgaaggggcactctggtga

SEQ ID NO: 237 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcattccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagccatggttcaggcagattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagaggggctgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 238 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacgaaactggaaggaaagatagtccaatatgaaaacttgaaatattcagtaatagtcaccgtccacacaggagaccagcaccaggtgggaaatgaaagcacagaacatgggacaactgcaactataacacctcaagctccttcaacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagcgttgaaactaagctggttcaagaaaggaagcagcatagggaaaatgtttgaggcaactgccagaggagcacgaaggatggccatactgggagacaccgcatgggactttggttctataggaggagtgttcacgtctgttggaaagttagtacaccagatttttggaactgcatatggagttttgttcagcggtgtttcctggaccatgaaaataggaataggagttctgctgacatggctaggactaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagacgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaaatgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatctagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaactccttggaggagctgggggatggacttgcaatgggcattatgattttgaaattattgactgactttcaatcacatcagttgtgggctaccttgctgtccatgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacttatcactagagaaagcagctgaggtctcctgggaagaagaagcagaacactctggtgcctcacacaacatattagtggaagtccaagatgatggaaccatgaagataaaggatgaagagagagatgacacgctaaccattctcctcaaagcaactctgctagcagtttcaggggtgtacccattatcaataccagcaaccctttttgtgtggtacttttggcagaaaaagaaacagagatctggagtgttatgggacacacctagccctccagaagtgcaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaggcatcacaggaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgttattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggagaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagatttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaggctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaagtaggagaggcacgggagcccaaggggaaacactgggagagaaatggaaaagacagctgaaccaactgagtaagtcagaattcaacacttataaaaggagtgggatcatggaagtggacagatccgaggccaaagagggactgaaaagaggagaaacaacaaaacatgcagtgtcgagaggaacagctaaactgaggtggtttgtggagaggaatcttgtgaaaccagaagggaaagtcatagacctcggttgtggaagaggtggctggtcatattattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtgggacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatacaaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacatgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagataccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtggtcctgaaggggcactctggtga

SEQ ID NO: 239 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgctggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgattacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacatgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgctgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacattttccttgcactatgcatggaagacaatggccatggtactgtcaattgtatctctcttccccttatgcctgtctacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaaggggatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcggctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctagttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctacgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcccgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaactctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagatactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 240 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagctctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgctgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcattgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagccatggttcaggcggattcaggatgtgtaattaattggaaaggtagagagctcaaatgtggaagtggcatttttgtcaccaacgaagttcacacttggacagagcaatacaaatttcaagctgactccccaaagagattatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttctcacaattggattgagtctagtagcatctgtggagttaccaaattccttggaggagctgggggatggacttgcaatgggcattatgattttaaaattactgactgactttcagtcacatcagctgtgggctaccttgctgtccttgacatttatcaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcctctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagctagagggtacatctcaacccgagtgggcatgggtgaggcagctgcgatcttcatgacagccactcccccaggatcagtggaggcctttccacagagcaatgcagtcatccaagatgaggaaagagacattcctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatatccgagatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgtacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaagtctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagatgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttataacatgatggggaagagagagaaaaagctaggagagttcggaaaggcaaaagggagtcgtgcaatatggtacatgtggttgggagcacgttttctagagttcgaagctcttggtttcatgaatgaagatcactggttcagtagagagaattcactcagcggagtggaaggagaaggactccacaaactcggatacatactcagagacatatcaaagattccagggggaaatatgtatgcagatgacacagccggatgggatacaaggataacagaggacgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatcttttcacccagcgaattggagatcccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttctgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctctaacatacaagtggccataaaccaagtgagaagactaattgggaatgagaattatctagattgcatgacatcaatgaagagattcaagaacgagggtgatcccgaaggggcactctggtga

SEQ ID NO: 241 - DNA, 10179 bp, Dengue virus; identical to SEQ ID NO: 229

SEQ ID NO: 242 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagtccaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccttgacatttgtcagaacaacgttttccctgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagagactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 243 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactagccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaggatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtattgtcaattgcatctctcttccccttatgcctgtccacgacctcccaaaaaacaacgtggcttccggtgctattgggatctcttggatgcaaaccactaaccatgtttcttataacagaaaccaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggtggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaagccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacgacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaactacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtactgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcggccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggaggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaatccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 244 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcggatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcctgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaaccataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaattttttcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagctacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctccttcccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagccgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaagaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtatcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcgaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 245 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtaatggctttcatagcattcctaagatttctagccatacctccaacagcaggaattttggctagatggggctcatttaagaagaatggagcgatcaaagtgctacggggtttcaagaaagaaatctcaaacatgctgaatataatgaatagaaggaaaagatctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggccgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctattggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagggagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtgcagaacaccaccttcatcatcgacggcccaaacaccccagaatgccctgatgatcaaagagcatggaacatttgggaagttgaggactatggatttggaattttcacgacaaatatatggttgaaaatgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtaggaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaagagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcatccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcacttctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttctgaaatggcagaggcgctcaagggaatgccaataaggtaccaaacaacagcagtgaagagtgaacacacaggaaaagagatagttgacctcatgtgccacgccactttcaccatgcgtctcctgtcccccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagccgtgttgactggtggagtgacgctgttcttcctatcaggaaggggcctagggaaaacatctatcggcttactctgcgtgatggcttcaagcgtactgctatggatggccagtgtggaaccccattggatagcggcctccatcatactggagttcttcctaatggtgctgcttattccagagccagacagacaacgcactccgcaggacaatcagctagcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcactacgccataattggacctggattgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgacattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaagtagccaacctggatatcattggccagaggatagagaacataaaacatgagcacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagtgcaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgaaaaaagagagggagcttcacaaacagggaaaatgtgccacgtgtgtttacaacatgatggggaagcgagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaacatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaactgtgatggatgtcatatccagacgtgaccaaagaggaagtggccaggtcggaacttatggcttgaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaaggaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 246 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacttcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctacccctgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttttagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacctatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcttttatagaagttaaaacatgtatctggccaaagtcccacactctatggagcaatggagttctggaaagtgaaatgataattccaaaaatctatggaggaccaatatctcagcacaactacagaccaggatatttcacacaaacggcagggccgtggcacctaggcaagttggaactggactttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacgaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagggacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaatactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatgtaccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 247 - DNA, 10179 bp, Dengue virus; identical to SEQ ID NO: 154

SEQ ID NO: 248 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacttgaagtgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagttactgacaaagaaaaaccagtcaacattgaggcagaaccgccctttggtgagagttacatcataataggagcaggtgaaaaaactttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcttggaccatgaaaataggaataggggttctgctgacatggctgggattaaactcaaggagcacgtccctttcgatgacgtgcattgcagttggcctagtaacactatacctaggagtcatggttcaggcggattcaggatgtgtaatcaattggaaaggtagagaactcaaatgtggaagtggcatttttgtcaccaatgaaattcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctaatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccagtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatccggatctcccatcgtgaacagagagggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgtctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggtgaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctctgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccggagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 249 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggccagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccattgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagagcatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagtaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagttggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactacgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaagatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgccacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaacgagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgctaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccattgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactctgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggttcacaggaaaccaacgtatgaaagagacgtggacctaggcgccggaacaagacatgtggcagtggaacctgaggtagccaacctagatatcattggccagaggatagagaacataaaacatgaacataaatcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttttcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 250 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcaacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 251 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcggatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcctgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaaccataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagctacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcctccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagccgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaagaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtatcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaatcgaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 252 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgctggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgattacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacatgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgtcgtggatgaacattgtggaaatcgaggaccatctcttaggaccacaacagttacaggaaagataattcatgaatggtgctgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacattttccttgcactatgcatggaagacaatggccatggtactgtcaattgtatctctcttccccttatgcctgtctacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaaggggatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcggctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgctcagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctagttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctacgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcccgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggagggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaactctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 253 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtactacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaaggtagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacattcaagacagctcatgcaaagaagcaggaagtagtcgtactaggatcacaagaaggagcaatgcacactgcgttgaccggagcaacagaaatccaaacgtctggaacgacaacaatctttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtgattaattggaaaggtagagaactcaaatgtggaagtggcatttttgtcaccaatgaagttcacacttggacagagcaatacaaatttcaagctgactccccaaagagactatcagcagccatcgggaaggcatgggaggagggcgtgtgtggaatacgatcaacaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataacgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacaaagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacagacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgctgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagaccttggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaatccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcgattctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 254 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggcaagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaagtgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcttggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcctcttaatgaaggaatcatggctgttggaatagtcagcatcctactaagttcactcctaaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatccggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataacataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctctgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 255 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggatacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagacttcaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagtcatggttcaggcggattcaggatgtgtaattaattggaaaggtagagagctaaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggctgaaattgcgtgactcttacacccaagtgtgtgaccatcggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtatctagctctgatggccacttttaaaatgagaccaatgtttgctgtcgggctattattccgtagactaacatccagagaagttctccttctcacaattggattgagtctagtggcatctgtggagttaccaaattccttggaggagctgggggatggacttgcaatgggcattatgattttaaaattattgactgactttcagtcacatcagctgtgggctaccttgctgtccttgacatttatcaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcaccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcctacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaggcagctgcgatcttcatgacagccactcccccaggatcagtggaggcctttccacagagcaatgcagttatccaagatgaggaaagagacattcctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccaatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactccgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgcgaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcattcccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatcttttcaccctgcgaattggagattccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggcaacctgggcctctaacatacaagtggccataaaccaagtgagaagactaattgggaatgagaattatctagattacatgacatcaatgaagagattcaagaacgagggtgatcccgaaggggcactctggtga

SEQ ID NO: 256 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttgtagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcgtatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataataggacaattgacatggaatgacttgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacattcatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggagaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtatccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacactatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaagagccaattccaatggcgacctatggatggaacctagtaaaactgcactccgggaaagacgtgttctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcgaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagattatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 257 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgtgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggggcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgagccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgctgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatattattgcgccgggctgaagaaagtcacagaagtgaagggatatacgaaaggaggacctggacatgaggagccaattccaatggcgacctatggatggaacctagtaaaactgcactccgggaaagacgtattctttacaccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagagacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 258 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttaaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgccaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtacagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacactccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagccgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcgggaaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggctagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagatatctccgaaatgggagcaaatttccgggccgatagggtgatagacccaagacggtgtctgaaaccggtaatactaaaagatggtccagagcgtgtcattttagcaggaccgatgccagtgactgtagccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaacctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaatcatcactcccatgatgaggcacacaattgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagagaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 259 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacgaaactggaaggaaagatagtccaatatgaaaacttgaaatattcagtaatagtcaccgtccacacaggagaccagcaccaggtgggaaatgaaagcacagaacatgggacaactgcaactataacacctcaagctccttcaacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgctggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaacagccagaggagcacgaaggatggccatactgggagacaccgcatgggactttggttctataggaggagtgttcacgtctgttggaaagttagtacaccagatttttggaactgcatatggagttttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagacgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctatacccaaatgtgtgaccaccggttaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatattttacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatctagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaactccttggaggagctgggggatggacttgcaatgggcattatgattttgaaattattgactgactttcaatcacatcagttgtgggctaccttgctgtccatgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacttatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtgcaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaggaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgttattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcccacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagatttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagctattgcaaaccaggcggccatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaggctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaagtaggagaggcacgggagctcaaggggaaacactgggagagaaatggaaaagacagctgaaccaactgagtaagtcagaattcaacacttataaaaggagtgggatcatggaagtggacagatccgaagccaaagagggactgaaaagaggagaaacaacaaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtgggacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatacaaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggtttcctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacatgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcattggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagataccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtggtcctgaaggggcactctggtga

SEQ ID NO: 260 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtggagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgtatttggccaaaatcccacactctatggagcaatggagttctggaaagtgaaatgataattccaaagatccatggaggaccaatatctcagcataactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacagttgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatctggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagcaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacggacatctccgaaatgggagcaaatttccgggccgacagggtgatagacccaagacggtgtctgaaaccggtaatattaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccggagagagaaaagagtgcagcaatagacggggaatatagactgcggggtgaagcaaggaaaacgtttgtggagctcatgagaagaggagacctacctgtctggctgtcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatggccagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgcgaatccatcacactggccactggacctctgaccacgctttgggagggatctccaggaaaattttggaacaccacgatagcggtttccatggcaaacatttttagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaagattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagctaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggggaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctgctggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttacccaacgaattagagaccccaaatttagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgactgggtcccaaccagccgcaccacctggtcgatccatgcccatcaccaatggatgacaacagaagacatgctgtcagtgtggaatagggtctggatagaggaaaacccatggatggaggacaaaacccgtatatccagttgggaagatgttccatatctaggaaaaagggaagatcaatggtgtggatctctgataggcttaactgcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 261 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcgaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaaccgcaactataacacctcaagctcctacgacggaaatacagctgaccgactacggagctcttacattggattgctcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagcaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaagtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcttactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagatgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatctgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagctgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 262 - DNA, 10179 bp, Dengue virus
atgaacaaccaacggaaaaagacggcccgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatactcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatacctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaagaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcaatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagaacaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaagaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctcctgaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggacggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaagaggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattatgccataattggacctggactgcaagcaaaagctactagagaagctcaaaaaaggacagcggccggaataatgaaaaatccaaccgttgatggaattgttgcaatagatttggatcctgtggtttatgatacaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgatttacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggacacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 263 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggatttggtttggaaacaagaaccgaaacgtggatgtcctctgaaggcgcttggaaacagatacaaagagtggagacttgggccctgagacacccaggattcacggtgatagcccttttcctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccagtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcaccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctctgggagggatctccaggaaaattttggaacaccacgatagcggtttccatggcaaacattttcagaggaagttacctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 264 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctgcagccttggcgttccatttgactacacgagggggagagccgcacatgatagttagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgcgttacaaaactggaaggaaagacagttcaatatgaaaacttgaaatattcagtaacagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggtcgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatctgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgttttttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtgaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcactcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacccggacatgaggagccaattccaatggcgacctatggatggaacctagtaaaactgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagccgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttgggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 265 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgtgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaacgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcaacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccctatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgagccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgatattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatattattgcgccgggctgaagaaagtcacagaagtgaagggatatacgaaaggaggacctggacatgaggagccaattccaatggcgacctatggatggaacctagtaaaactgcactccgggaaagacgtattctttacaccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgacatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 266 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagattaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcaccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttacctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggggtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 267 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagctatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaagtgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcttggaccatgaaaataggaataggggttctgctgacatggctgggattaaactcaaggagcacgtccctttcgatgacgtgcattgcagttggcctagtaacactatacctaggagtcatggttcaggcggattcaggatgtgtaatcaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaactgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcctcttaatgaaggaatcatggctgttggaatagtcagcatcctactaagttcactcctaaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgttaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatccggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtattctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctctgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 268 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaaccgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatggaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggattatggatttggaattttcacgacaaacatatggctgaaattgcgtgattcctacacccaagtgtgtgaccaccggctaatgtcagctgccatcaaggacagcaaggcagttcacgccgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatttgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaggggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggtcagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaggttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgagcatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 269 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaagggaagcctaataacgtgtgctaagttcaagtgtgttacaaaactggaaggaaagacagttcaatatgaaaacttaaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccctatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaagatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcatgccactttcactatgcgcctcttgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 270 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctcctcatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcaacagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttattattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcaacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 271 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtaatggctttcatagcattcctaagatttctagccatacctccaacagcaggaattttggctagatggggctcatttaagaagaatggagcgatcaaagtgctacggggtttcaagaaagaaatctcaaacatgctgaatataatgaatagaaggaaaagatctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggccgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctattggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagggagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgttggagatgtagttgggatcttggctcaaggaaaaaaaatgattaggccacaacccatggaacacaaatactcgtggaaaagctggggaaaagctaaaatcataggggcagatgtgcagaacaccaccttcatcatcgacggcccaaacaccccagaatgccctgatgatcaaagagcatggaacatttgggaagttgaggactatggatttggaattttcacgacaaatatatggttgaaaatgcgtgactcctacacccaagtgtgtgaccaccggctaatgtcagctgccatcaaggacagcaaggcagttcatgctgacatggggtactggatagaaagtgaaaagaacgagacctggaagctagcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtaggaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaagagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcatccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcacttctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacagtatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtaaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctctttgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagccgtgttgactggtggagtgacgctgttcttcctatcaggaaggggcctagggaaaacatctatcggcttactctgcgtgatggcttcaagcgtactgctatggatggccagtgtggaaccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcactacgccataattggacctggattgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgacattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaagtagccaacctggatatcattggccagaggatagagaacataaaacatgagcacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagtgcaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgaaaaaagagagggagcttcacaaacagggaaaatgtgccacgtgtgtttacaacatgatggggaagcgagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaacatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaactgtgatggatgtcatatccagacgtgaccaaagaggaagtggccaggtcggaacttatggcttgaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 272 - DNA, 10179 bp, Dengue virus; identical to SEQ ID NO: 149

SEQ ID NO: 273 - DNA, 10179 bp, Dengue virus; identical to SEQ ID NO: 151

SEQ ID NO: 274 - DNA, 10179 bp, Dengue virus; identical to SEQ ID NO: 155

SEQ ID NO: 275 - DNA, 10179 bp, Dengue virus; identical to SEQ ID NO: 156

SEQ ID NO: 276 - DNA, 10179 bp, Dengue virus; identical to SEQ ID NO: 145

SEQ ID NO: 277 - DNA, 10179 bp, Dengue virus; identical to SEQ ID NO: 146

SEQ ID NO: 278 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcaggccaaggacccatgaaattggtgatggctttcatagcatttctaagatttctagccatacccccaacagcaggaattttggctagatggagctcattcaagaagaatggagcaatcaaagtgttacggggtttcaaaaaagagatctcaagcatgttgaacataatgaacaggaggaaaagatccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagctttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacatgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggagcgacagaaatccagacgtcaggaacgacaacaattttcgcaggacatctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcagatatcaaatgaattgaaccacattctacttgagaatgacatgaaattcacagtggttgtaggagatgccaacggaattttggcccaaggaaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaactacaacagtcacaggaaagataatccatgaatggtgttgcagatcctgcacgctaccccccttacgtttcagaggagaagacggatgttggtatggcatggaaatcagaccagtgaaggagaaggaggagaatctagttaggtcaatggtctctgcagggtcaggagaagtggatagtttttcattaggaatactatgcgtatcaataatgattgaagaagtgatgagatccagatggagtagaaagatgctgatgactggaacactggctgtttttctccttcttataatgggacaactgacatggaatgatctgattaggttatgcatcatggttggagctaatgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcattggattatgcatggaaaacaacggctatggcactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgataatggcatctatagaatcttgcaaagaggactgttgggcaggtcccaagtaggagtgggagtcttccaagacggcgtgttccacacaatgtggcacgtcaccagaggagctgtccttatgtaccaagggaagagactggaaccaagctgggccagtgtcaaaaaggacttgatctcatatggaggaggttggaggttccaaggatcatggaacacgggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttcttcttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgccacaatgctggacgtagacctacacccagcttcagcctggaccctctatgcagtagccacaacagtcatcactcccatgatgagacacacaattgaaaatacaacggcaaacatttccctgaccgccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttattgatactttgtacatcacagatcctcttgatgcggaccacatgggccttgtgtgaatccatcacactggctactggacccctgaccactctctgggagggatctccaggaaaattctggaataccacaatagcagtgtccatggcaaatatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcgaatgcaaagaaaacatggagggatgctagtgcgaaacccactctcaagaaattccacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggccaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagctataaaccaagtgagaaggctcatcgggaatgagaattatttagattacatgacatcaatgaagagattcaagaatgagagtgattccgaaggagcactctggtaa

SEQ ID NO: 279 - DNA, 10179 bp, Dengue virus
atgaacaaccaacggaaaaagacgggtcgaccgtctttcaatatgctgaaacgcgcgagaaaccgcgtgtcaactggttcacagttggcgaagagattctcaaaaggattgctttcgggccaaggacccatgaaattggtgatggcttttatagcatttctaagatttctagccatacccccaacagcaggaattttggctagatggagctcattcaagaagaatggagcgatcaaagtgttacggggtttcaaaaaagagatctcaagcatgttgaatattatgaacaggaggaaaaaatctgtgaccatgctcctcatgctgctgcccacagccctggcgttccatttgactacacgagggggagagccacacatgatagttagtaagcaggaaagaggaaagtcactgttgtttaagacctctgcaggcatcaatatgtgcactctcattgcgatggatctgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagggacttcgttgaaggactgtcaggagcaacgtgggtggacgtagtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaagggaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacgatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcaccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaagagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccaaaatcccacactctatggagtaatggagttttggaaagtgaaatgataatcccaaagatatatggaggaccaatatctcagcacaactacagaccagggtatttcacacaaacagcagggccatggcacctaggcaagttggaattggatttcgacttgtgtgaaggtaccacagttgttgtggatgaacattgtggaaatcgaggcccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtgggagtgggagttttccaggacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagtagacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaagaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacactccagaagggatcattccagccctctttgagccagagagagaaaagagtgcagcaatagatggagagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagttcaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattggaaaccacaaagaaagacctggggattggctatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaaaccaacatatgaaagagacgtggacttaggcgctggaacaagacatgtggcagtggaaccagaggtagccaacctagatattattggccagaggatagagaatataaaaaatgaacacaagtcaacatggtattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggccaaaatcactgacatcatggagcctgaacacgctctattagctacgtcaatttttaagctgacctaccaaaacaaggtggtaagggtgcaaagaccagcaaaaaatggaaccgtgatggatgttatatccagacgagaccagagaggaagtgggcaggtcggaacctatggcttaaatactttcaccaatatggaggtccaactaataagacaaatggagtctgaaggaatctttttacccagcgaattggaaacccccaatctagctgagagagttcttaactggttggaaaaacatggcactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggttccaaccagccgcacaacctggtcaatccatgctcaccatcaatggatgacaacagaagatatgttatcagtgtggaatagggtttggatagaggaaaacccatggatggaggataaaactcatgtgtccagctgggaagaagtcccatacttagggaaaagggaagatcaatggtgtggatccctgataggcttgacagcgagggccacttgggccactaacatacaagtggccataaaccaagtgagaaggctcatcggaaatgagaattatctagattacatgacatcaatgaagagattcaagaatgagagtgatcccgaaggggcactctggtaa

SEQ ID NO: 280 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtaatggctttcatagcattcctaagatttctagccatacctccaacagcaggaattttggctagatggggctcattcaagaagaatggagcgatcaaagtgctacggggtttcaagaaagaaatctcaaacatgctgaatataatgaatagaaggaaaagatctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaaggaaaaaaaatgattaggccacaacctatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctcttttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccattaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctacagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggatcatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacctgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaactagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcattccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcagatgcaaagaaaacatggaggaatgctagtgcgaaatccactttcaagaaattctactcatgaaatgtattgggtttcatgtggaacaggaaacatcgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacataagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgaaagggttctcgactggctggaaaaatatggcgtcgaaaggctgaaaagaatggcaatcagcggagatgactgcgtggtgaaaccaattgatgacaggttcgcaacagccctagcagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtatttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 281 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagctttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggcttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattatcttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtgatagtcaccgtccacactggagaccagcaccaggtgggaaatgaaagcacagaacacgggacaactgcaactataacacctcaagctccttcaacggaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagagacttggaacagacaagatttgcttgtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacatgcattgcagttggcctagtaacattatacctaggagtcatggttcaggcggattcaggatgtgtaattaattggaaaggcagagaactcaaatgtggaagtggcatttttgtcaccaatgaagttcacacttggacagagcaatacaaatttcaagctgactccccaaagagactatcagctgccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggtcgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctagcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttaatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgttagctgtaggactattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgtattccttgcactatgcatggaagacaatggccatggtactgtcaattgtatctctcttccccttatgcctgtccacgacctcccaaaaaacaacatggcttccggtgctattgggatctcttggatgcaaaccactaaccatgtttctcatagcagaaaacaaaatctggggaaggaaaagttggcccctcaatgaaggaatcatggctgttggaatagtcagcattctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggctccaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcccctaccagagattgaaaacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcagttgagcagaaaaacttttgatacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaaggagcgtctcaggtgatctaatattagaaatagggaaacttccacaacacctgacgcaaagggcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcggctatattaatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccagctgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaatattgtgtcagcagtaaacatgacatccagaatgctgctaaatcgattcacaatggctcacaggaaaccaacgtatgaaagagacgtggacctaggcgccggaacaagacatgtggcagtggaacctgaggtagccaacctagatatcataggccagaggatagagaacataaaacatgaacataagtcaacatggcattatgatgaggacaatccatataaaacatgggcctaccatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctctctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcgatctttaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaggtggccataaaccaagtgagaagactaattgggaatgagaattatctagattacatgacatcaatgaagagattcaagaacgagagtgatcctgaaggggcactctggtga

SEQ ID NO: 282 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacttgatctcatatggaggaggttggaggcttcaaggatcctggaacacaggagaagaagtgcaggtgattgctgttgaaccagggaaaaaccccaaaaacgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctccagtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctctaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagagatagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacacaacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 283 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacgtttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatatgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaagaagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgtcctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtaccgctagctgggccactaatagctggaggcatgctaatagcatgttatgttatatctggaagctcagccgacctatcattagagaaagcggctgaggtctcctgggaagaggaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtgggggtaggagttttccaagaaaacgtgttccacacaatgtggcatgtcaccaggggagctgtactcatgtatcaagggaagagattggaaccgagctgggccagtgtcaaaaaagacctgatctcatacggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgatggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtagtggcttcaagcgttttgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgaaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 284 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggatttggtttggaaacaagaaccgaaacgtggatgtcctctgaaggcgcttggaaacagatacaaagagtggagacttgggccctgagacacccaggattcacggtgatagcccttttcctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccagtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcaccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtagtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctctgggagggatctccaggaaaattttggaacaccacgatagcggtttccatggcaaacattttcagaggaagttacctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 285 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgactatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggtgagcaccgacgagacaaacgttccgtcgcactggccccacacgtgggacttggtttggaaacaagaaccgaaacgtggatgtcctccgaaggcgcttggaaacagatacaaagagtggagacttgggccctgagacatccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgagaaagctttgaaactaagttggttcaagaaaggaagcagcatagggaaaatgtttgaggcaactgccagaggagcacgaaggatggccatactgggagacaccgcatgggactttggttccataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtctctttcgatgacgtgcattgcagttggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtgattgtaggagatgttgctgggatcttgggccaaggaagaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcaacacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctaggggatggacttgcaatgggcattatgattttaaaattgttgactgactttcaatcacatcagctgtgggctaccttgctgtccttgacatttatcaaaacaacattttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactagtagctggaggcatgctaatagcatgttatgttatatctggaagctcagccgatctatcactagagaaagcggctgaggtctcctgggaagaagaagcagagcactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggtaggtcccaagtaggggtaggagtttttcaagaaaacgtgttccacacaatgtggcatgtcaccaggggagctgtactcatgtatcaagggaagagactagaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaacggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagtcgacctcatgtgtcacgccactttcaccatgcgcctcctgtctcccgtgagagttcccaattacaacatgattatcatggatgaagcacattttacagatccatccagcatagcggccagagggtacatctcaactcgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaatgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggagttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccgatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacgtatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgaaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagactacatgacatcaatgaagagattcaagaacgagagtgatcccgaaggggcactctggtga

SEQ ID NO: 286 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggtctagtaacattgtacctaggagttatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccactttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagatgggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgccttctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaagacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagatttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctaacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaatatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagccctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttgggaagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 287 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccttgacatttgtcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgacgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggcatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgatcgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctatctcccgtgagagttcccaattacaacatgattatcatggatgaagcacattttaccgatccatccagcatagcggccagagggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagagactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcatcaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 288 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcctggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgccgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaattcaaacgtccggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggaataacccagagtgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaagctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggcaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcggctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtcatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgactctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctatagaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgttgacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccaggcgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 289 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcaacagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcagggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgaccttatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtatcaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaggttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttattattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcaacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 290 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctaatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaataaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 291 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaatagatgcaccatgcaagatccctttttcgacccaagatgaaaaaggagtaacccagaatgggagactaataacagccaaccctatagtcactgacaaagaaaaaccagtcaatattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggaatacaaatactcgtggaaaatctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctagaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttacgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgacggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgatcatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgaccgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcccacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgatgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacaggtccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaattatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatacatactcagagacatatcaaagattccagggggaaacatgtatgcagatgacacagccggatgggacacaaggataacagaggatgaccttcagaacgaggccaaaattactgacatcatggaacccgaacatgccctactggctaagtcaatcttcaagttaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaacgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 292 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggttcattcaagaagagtggagcgatcaaagtgctacggggtttcaagaaagaaatctcaaacatgttgaatacaatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagatacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataataatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatactggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaattatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaagaataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 293 - DNA, 10179 bp, Dengue virus
atgaacaaccaacggaaaaagacggctcgaccgtctttcaatatgctgaaacgcgcgagaaaccgcgtgtcaactggttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagagcactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaacagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 294 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcagaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggctatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaatctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccgtctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaggagatagttgacctcatgtgtcacgccactttcactatgcgcctcctgtctcccgtgagagttcccaattacaacatgatcatcatggatgaagcacatttcaccgatccatccagcatagcggccagagggtacatctcaacccgagtgggcatgggtgaggcagctgcgatcttcatgacagctactcccccaggatcagtggaggcctttccacagagcaacgcagttatccaagatgaggaaagagacattcccgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacaggtccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagttacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatatcggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagttaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcaactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 295 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcgaaaggattgctctcaggccaaggacccatgaaattggtgatggctttcatagcattcctaagatttctagccatacccccaacagcaggaattttggctagatggggctcattcaagaagaatggagcgatcaaagtgcttcggggtttcaagaaagaaatctcaaacatgttgaatataatgaatagaaggaaaagatctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggtttattcaagctagagaaagaagtggctgagacccagcatggaaccgttttagtgcagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatccgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacaacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtagaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattataacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacttttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcctagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgacaatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagaccttggttgtggaagaggtggctggtcatactattgcgctgggctgaagaaagtcacagaagtgaagggatacacaaaaggaggacccggacatgaagaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagattagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgatagtgatcccgaaggggcactctggtga

SEQ ID NO: 296 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgctgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagttaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattgtgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgttagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatctgaagccaaagagggattgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaagctctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgatatcaatgaagagattcaagaacgagagtgatcccgaaggggcactctggtga

SEQ ID NO: 297 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggattttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaagatgaagagagagatgacacgctaaccattctccttaaagcaactctgttagcagtttcaggggtgtacccattatcaataccagcgaccctcttcgtgtggcacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactattcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattattactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 298 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcaaagtgctacggggtttcaagaaagaaatctcaaatatgttgaatataatgaatagaaggaaaagatctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggtagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggtaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaattaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagctgccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactagctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtacttcttctaacaattggattgagtctagtggcatctgtggagttaccaaattccttggaggagctgggggatggacttgcaatgggcattatgattttaaaattattgactgactttcaatcacatcagttgtgggctaccttgctatccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctgggggcatgctaatagcatgttatgttatatctggaagctcagccgacctatcactagagaaagcagctgaggtctcctgggaagaagaagcagaacactctggtgcctcacacaacatattagtggaagtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccttagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaactgttgatggaattgttgcaatagacttggatcctgtggtttatgatgcaaaatttgagaagcaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaaccatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacacaacaccttttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagatttaagaacgagagtgaccctgaaggggcactctggtga

SEQ ID NO: 299 - DNA, 10179 bp, Dengue virus
atgaacaaccaacgaaaaaagacggctcgaccgtctttcaatatgctgaaacgcgcgagaaaccgcgtgtcaactgtttcacagttggcgaagagattctcgaaaggattgctctcaggccaaggacccatgaaattggtgatggctttcatagcattcctaagatttctagccatacccccaacagcaggaattttggctagatggggctcattcaagaagaatggagcgatcaaagtgcttcggggtttcaagaaagaaatctcaaacatgttgaatataatgaatagaaggaaaagatctgtgaccatgctccttatgctgatacctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagctgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgagatggtgttgttgacaatgaaagaaaaatcatggctagtccacaaacaatggtttctagacctaccattgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttttagtgcagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggagcatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatggttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtttcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaggggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagtaatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagagatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctaaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggttggtcatattattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgcaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacatcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 300 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcatttaagaagaatggagcgatcagagtgctacggggtttcaagaaagaaatctcaaatatgttgaatataatgaatagaaggaaaagatctgtgaccatgctccttatgttgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgtattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaagggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaactggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacattatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaaaacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcttgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaattaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgcggctgttgaaaatcaccaccatgccgcaatgctggacgtagacttacatccagcttcagcctggaccctctatgcagtggccacaacaatcatcactcccatgatgaggcacacaatcgaaaacacaacggcaaacatttccctgacagccattgcaaaccaggcggccatattgatgggacttgacaaaggatggccaatatcaaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtagagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgatacccttctgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagatatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 301 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagttggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaagatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattattactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 302 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaattccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttttagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 303 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgattcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatcgcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcacctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctgggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 304 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagagtggagcgatcaaagtgctacggggtttcaagaaagaagtctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaagatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggtctgctggaaaccacaaagaaagacttagggattggccatgtggctgttgaaaatcaccaccatgccgcaatgctggatgtagacttacatccagcttcagcctggaccctctatgcagtggccacaacaattattactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 305 - DNA, 10179 bp, Dengue virus
atgaacaaccaacggaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagagtggagcgatcaaagtgctacggggtttcaagaaagaaatctcaaacatgttgaatataatgaatagaaggaaaagatctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgcttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacaggccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagcagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatcactcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcttactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgacccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaacctgaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaagatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccaagagagttctcgactggctggaaaaatatggcgtcgaaaggctgaaaagaatggcaatcagcggagatgactgcgtagtgaaaccaattgatgataggtttgcaacagccttgacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

(The sequence listing continues in the following parts.)

What is claimed is:

1. An attenuated form of a virulent virus comprising an RNA encoding a viral protein or a nucleic acid sequence transcribable to said RNA, comprising at least one nucleotide in a region of evolutionarily conserved local RNA folding energy synonymously substituted to another nucleotide,
   wherein said region of evolutionarily conserved local RNA folding energy comprises folding energy below a predetermined threshold and said substitution increases said folding energy, or
   said region of evolutionarily conserved RNA folding energy comprises folding energy above a predetermined threshold and said substitution decreases said folding energy, wherein said predetermined threshold is derived from the average local folding energy of a randomized sequence of the virulent virus, wherein said randomized sequence encodes an amino acid sequence which is identical to the amino acid sequence of said virulent virus;
   and wherein said viral protein of said attenuated virus comprises an amino acid sequence which is identical to the amino acid sequence of said viral protein of the virulent virus and said at least one substitution decreases replicative fitness of said attenuated form of a virus as compared to said virulent virus.

2. The attenuated virus of claim 1, wherein the untranslated region of said RNA is identical to the untranslated region of the corresponding RNA of the virulent virus.

3. The attenuated virus of claim 1, wherein the virulent virus:
   a. is selected from a natural isolate and a mutant of a natural isolate;
   b. infects an animal or a plant, optionally wherein the animal is a human; or
   c. induces a protective immune response in an animal host.

4. The attenuated virus of claim 1, comprising a plurality of synonymous substitutions and wherein a synonymous substitution of said plurality synonymous substitutions is present at each region of evolutionarily conserved local RNA folding energy for which a synonymous substitution exists that increases folding energy of a region comprising folding energy below said predetermined threshold or decreases folding energy of a region comprising folding energy above said predetermined threshold.

5. The attenuated virus of claim 1, wherein said region of evolutionarily conserved local RNA folding energy is increased or decreased by a maximum possible amount while maintaining said amino acid sequence.

6. The attenuated virus of claim 1, wherein the virus comprises at least 10% of the regions of evolutionarily conserved local RNA folding energy throughout a genome of said virus increased or decreased to comprise a maximum possible change in local RNA folding energy possible while maintaining said amino acid sequence.

7. The attenuated virus of claim 1, wherein said RNA encodes more than one protein, optionally wherein one of said proteins is a capsid protein.

8. The attenuated virus of claim 1, wherein the virus is selected from the group consisting of dengue virus, poliovirus, rhinovirus, influenza virus, severe acute respiratory syndrome (SARS) coronavirus, Human Immunodeficiency Virus (HIV), Hepatitis C Virus (HCV), infectious bronchitis virus, Ebolavirus, Marburg virus, West Nile disease virus, Epstein-Barr virus (EBV), yellow fever virus, Zika virus, and flavivirus.

9. The attenuated virus of claim 8, wherein the dengue virus is selected from the group consisting of dengue virus type 1, dengue virus type 2, dengue virus type 3, and dengue virus type 4.

10. A pharmaceutical composition comprising the attenuated virus of claim 1 and a pharmaceutically acceptable carrier, optionally further comprising an adjuvant.

11. The pharmaceutical composition of claim 10, wherein said composition is an immunogenic composition and the attenuated virus induces a substantially similar immune response in a host animal as the corresponding wild type virus.

12. A method for eliciting an immune response in a subject or immunizing a subject against a virus-associated disease comprising administering to the subject a prophylactically or therapeutically effective dose of the pharmaceutical composition of claim 10, thereby eliciting an immune response in the subject, optionally wherein the subject has been exposed to a pathogenic virus.

13. The attenuated virus of claim 1, wherein said at least one nucleotide substituted to another nucleotide maintains the overall codon usage bias, GC content or both of said virulent virus.

14. The attenuated virus of claim 1, wherein said attenuated virus comprises a total change in local folding energy of at least 20% of the maximum change in local folding energy that can be generated by modifying all regions of evolutionarily conserved local RNA folding energy for which a synonymous substitution exists that increases folding energy of a region comprising folding energy below said predetermined threshold or decreases folding energy of a region comprising folding energy above said predetermined threshold.

15. The attenuated virus of claim 1, wherein said substitution increases said folding energy by greater than 3 kcal/mol or decreases said folding energy by greater than 9 kcal/mol.

16. The attenuated virus of claim 9, wherein the genome of said dengue virus is encoded by a sequence selected from the group consisting of SEQ ID NOs: 1671-1734.

17. The attenuated virus of claim 1, wherein said randomized sequence further retains the dinucleotide content, GC content, codon bias or a combination thereof of said virulent virus.

18. The attenuated virus of claim 1, wherein said randomized sequence of the virulent virus is at least 100 randomized sequences of the virulent virus.

* * * * *